US012703748B2

(12) United States Patent
Desjarlais et al.

(10) Patent No.: US 12,703,748 B2
(45) **Date of Patent: *Aug. 11, 2026**

(54) ANTI-CD28 COMPOSITIONS

(71) Applicant: Xencor, Inc., Pasadena, CA (US)

(72) Inventors: John R. Desjarlais, Pasadena, CA (US); Gregory Moore, Azusa, CA (US); Michael Hedvat, Encino, CA (US); Juan Diaz, Anaheim Hills, CA (US); Veronica Gusti Zeng, Duarte, CA (US)

(73) Assignee: Xencor, Inc., Pasadena, CA (US)

( * ) Notice: Subject to any disclaimer, the term of this patent is extended or adjusted under 35 U.S.C. 154(b) by 476 days.

This patent is subject to a terminal disclaimer.

(21) Appl. No.: 18/074,411

(22) Filed: Dec. 2, 2022

(65) Prior Publication Data

US 2023/0257466 A1 Aug. 17, 2023

Related U.S. Application Data

(63) Continuation of application No. 17/558,372, filed on Dec. 21, 2021, now Pat. No. 11,591,401, which is a continuation of application No. 17/407,135, filed on Aug. 19, 2021, now Pat. No. 11,919,958.

(60) Provisional application No. 63/067,834, filed on Aug. 19, 2020, provisional application No. 63/092,272, filed on Oct. 15, 2020.

(51) Int. Cl.
*C07K 16/00* (2006.01)
*C07K 16/28* (2006.01)

(52) U.S. Cl.
CPC ...... *C07K 16/2827* (2013.01); *C07K 16/2818* (2013.01); *C07K 2317/31* (2013.01); *C07K 2317/522* (2013.01); *C07K 2317/524* (2013.01); *C07K 2317/526* (2013.01); *C07K 2317/53* (2013.01); *C07K 2317/56* (2013.01); *C07K 2317/622* (2013.01)

(58) Field of Classification Search
None
See application file for complete search history.

(56) References Cited

U.S. PATENT DOCUMENTS 5,601,819 A 2/1997 Wong et al.
6,551,592 B2 4/2003 Lindhofer et al.
6,699,715 B1 3/2004 Ledbetter et al.
6,881,557 B2 4/2005 Foote
6,994,853 B1 2/2006 Lindhofer et al.
7,538,196 B2 5/2009 Jung
8,709,421 B2 4/2014 Heiss et al.
9,017,676 B2 4/2015 Lindhofer
9,382,329 B2 7/2016 Chang et al.
9,441,034 B2 9/2016 Sivakumar et al.
10,208,119 B2 2/2019 Fang et al.
10,294,300 B2 5/2019 Raum et al.
10,364,287 B2 7/2019 Mary et al.
10,517,949 B2 12/2019 Wang et al.
10,669,337 B2 6/2020 Irving et al.
10,752,697 B2 8/2020 Park et al.
11,370,828 B2 6/2022 Westendorf et al.
11,396,544 B2 7/2022 Murphy et al.
11,591,401 B2 * 2/2023 Desjarlais .......... C07K 16/3069
11,919,958 B2 * 3/2024 Desjarlais .......... C07K 16/2809
2001/0001310 A1 5/2001 Weiner et al.
2002/0076406 A1 6/2002 Leung
2002/0103345 A1 8/2002 Zhu
2002/0115134 A1 8/2002 Jung
2003/0185832 A1 10/2003 Thorpe
2004/0253250 A1 12/2004 Ledbetter et al.
2005/0079170 A1 4/2005 Le Gall et al.
2005/0175606 A1 8/2005 Huang et al.
2006/0115481 A1 6/2006 Lindhofer et al.
2006/0188493 A1 8/2006 Heunig
2007/0036783 A1 2/2007 Humeau et al.
2007/0212350 A1 9/2007 Govindan et al.
2008/0145362 A1 6/2008 Kipriyanov et al.
2008/0299137 A1 12/2008 Svendsen et al.
2008/0305105 A1 12/2008 Kufer et al.
2009/0117108 A1 5/2009 Wang et al.
2009/0246204 A1 10/2009 Hunig (Continued)

FOREIGN PATENT DOCUMENTS

EP 1874821 B1 4/2013
EP 3575319 A1 12/2019

(Continued)

OTHER PUBLICATIONS

Chiu et al. Antibodies 2019, 8,55; 1-80. (Year: 2019).*
Sela-Culang et al. Frontiers in Immunology, 2013, vol. 4, Article 302, pp. 1-13. (Year: 2013).*
Steffen Dickopf et al, “Format and geometries matter: Structure-based design defines the functionality of bispecific antibodies”, *Computational and Structural Biotechnology Journal,* vol. 18, May 14, 2020 (May 14, 2020), p. 1221-1227.
Roda-Navarro Pedro et al, “Understanding the Spatial Topology of Artificial Immunological Synapses Assembled in T Cell-Redirecting Strategies: A Major Issue in Cancer Immunotherapy”, Frontiers in Cell and Developmental Biology, vol. 7, Jan. 10, 2020 (Jan. 10, 2020).

(Continued)

*Primary Examiner* — Chun W Dahle
(74) *Attorney, Agent, or Firm* — Louis-Vu T. Nguyen; Christopher J. Betti; Morgan, Lewis & Bockius, LLP

(57) ABSTRACT

Provided herein are novel anti-CD28 x anti-B7H3 (also referred to as “αCD28 x αB7H3”) heterodimeric bispecific antibodies and methods of using such antibodies for the treatment of cancers. Subject αCD28 x αB7H3 antibodies are capable of agonistically binding to CD28 costimulatory molecules on T cells and targeting to B7H3 on tumor cells. Thus, such antibodies selectively enhance anti-tumor activity at tumor sites while minimizing peripheral toxicity. The subject antibodies provided herein are particularly useful for enhancing anti-tumor activity when used in combination with other anti-cancer therapies.

10 Claims, 111 Drawing Sheets

Specification includes a Sequence Listing.

(56) References Cited

U.S. PATENT DOCUMENTS

2010/0291112 A1 11/2010 Kellner et al.
2010/0322933 A1 12/2010 Lindhofer et al.
2010/0330034 A1 12/2010 Bigler et al.
2011/0189735 A1 8/2011 Hanke et al.
2011/0313135 A1 12/2011 Vanhove et al.
2013/0078236 A1 3/2013 Mary et al.
2014/0348839 A1 11/2014 Chowdhury et al.
2015/0119555 A1 4/2015 Jung et al.
2016/0137980 A1 5/2016 Abbot et al.
2016/0355608 A1 12/2016 Bernett et al.
2017/0335016 A1 11/2017 Takahashi
2018/0079798 A1 3/2018 Protzer et al.
2018/0112000 A1 4/2018 Nolle et al.
2018/0118836 A1 5/2018 Bernett et al.
2018/0127501 A1 5/2018 Bernett et al.
2019/0106504 A1 4/2019 Wu et al.
2019/0233534 A1 8/2019 Mehlin et al.
2019/0375852 A1 12/2019 Lindhofer et al.
2019/0389951 A1 12/2019 Murphy et al.
2020/0024360 A1 1/2020 Anderson et al.
2020/0048350 A1 2/2020 Eckelman et al.
2020/0071421 A1 3/2020 Zhou
2020/0140552 A1 5/2020 Wu et al.
2020/0157213 A1 5/2020 Zhu et al.
2020/0157222 A1 5/2020 Fang et al.
2020/0199233 A1 6/2020 Murphy et al.
2020/0199234 A1 6/2020 Georges et al.
2020/0239576 A1 7/2020 Murphy et al.
2020/0247862 A1 8/2020 Bernett et al.
2020/0299388 A1 9/2020 Skokos et al.
2020/0376136 A1 12/2020 Rudge et al.
2021/0040210 A1 2/2021 Ganesan et al.
2021/0047435 A1 2/2021 Luo et al.
2021/0171596 A1 6/2021 Moore et al.
2022/0089766 A1 3/2022 DiLillo et al.
2022/0098306 A1 3/2022 Desjarlais et al.
2022/0119530 A1 4/2022 Desjarlais et al.
2022/0135684 A1 5/2022 Desjarlais et al.
2022/0233690 A1 7/2022 Olson et al.
2023/0040715 A1 2/2023 Zwolak et al.
2023/0257466 A1 8/2023 Desjarlais et al.
2023/0265218 A1 8/2023 Desjarlais et al.
2023/0340128 A1 10/2023 Desjarlais et al.
2023/0383012 A1 11/2023 Moore et al.
2024/0059786 A1 2/2024 Desjarlais et al.
2025/0043001 A1 2/2025 Moore et al.
2025/0084179 A1 3/2025 Bernett et al.
2025/0084186 A1 3/2025 Nisthal et al.

FOREIGN PATENT DOCUMENTS

EP 2981281 B1 7/2020
EP 3177645 B1 2/2021
WO WO1998004592 A1 2/1998
WO WO200247721 A1 6/2002
WO WO2002051871 A2 7/2002
WO WO2003048194 A2 6/2003
WO WO2003057732 A2 7/2003
WO WO2003074566 A2 9/2003
WO WO2003078468 A2 9/2003
WO WO2004087876 A2 10/2004
WO WO2004087876 A3 3/2005
WO WO2005095456 A1 10/2005
WO WO2009062001 A1 5/2009
WO WO2010151792 A1 12/2010
WO WO 2011097603 A1 8/2011
WO WO2012088302 A2 6/2012
WO WO2014055897 A2 4/2014
WO WO2014165818 A2 10/2014
WO WO2014165818 A3 10/2014
WO WO2015112805 A1 7/2015
WO WO2016086186 A2 6/2016
WO WO2015112805 A8 7/2016
WO WO2016185016 A1 11/2016
WO WO2017103003 A1 6/2017
WO WO2017205738 A1 11/2017
WO WO2017220990 A1 12/2017
WO WO2018059502 A1 4/2018
WO WO2018184966 A1 10/2018
WO WO2019009726 A1 1/2019
WO WO2019016392 A1 1/2019
WO WO2019080872 A1 5/2019
WO WO2019190327 A2 10/2019
WO WO2019197583 A1 10/2019
WO WO2019241758 A1 12/2019
WO WO2019245991 A1 12/2019
WO WO2020006509 A1 1/2020
WO WO2020011868 A1 1/2020
WO WO2020014270 A1 1/2020
WO WO 2020023553 A1 1/2020
WO WO 2020033702 A1 2/2020
WO WO2020076970 A1 4/2020
WO WO2020103100 A1 5/2020
WO WO2020127618 A1 6/2020
WO WO2020132066 A1 6/2020
WO WO2020180726 A1 9/2020
WO WO2020227515 A1 11/2020
WO WO2021026387 A2 2/2021
WO WO2021030657 A1 2/2021
WO WO2021155071 A1 8/2021
WO WO2021155380 A1 8/2021
WO WO2021173307 A1 9/2021
WO WO2021181233 A2 9/2021
WO WO2021197359 A1 10/2021
WO WO2021207242 A2 10/2021
WO WO2021229507 A2 11/2021
WO WO2021231969 A1 11/2021
WO WO2021259890 A1 12/2021
WO WO2021260064 A1 12/2021
WO WO2022040482 A1 2/2022
WO WO2022056199 A1 3/2022
WO WO2022061098 A1 3/2022
WO WO2022081886 A1 4/2022
WO WO2022056197 A1 8/2022
WO WO2022162518 A2 8/2022
WO WO2022165171 A1 8/2022
WO WO2022200443 A1 9/2022
WO WO2022201053 A1 9/2022
WO WO2022258673 A1 12/2022
WO WO2023046322 A1 3/2023
WO WO2023164627 A1 8/2023
WO WO2023164640 A1 8/2023
WO WO2025049613 A1 3/2025

OTHER PUBLICATIONS

Suurs Frans V et al, "A review of bispecific antibodies and antibody constructs in oncology and clinical challenges", Apr. 24, 2019 (Apr. 24, 2019), vol. 201, p. 103-119.

Chen Shixue et al, "Immunoglobulin Gamma-Like Therapeutic Bispecific Antibody Formats for Tumor Therapy", US Feb. 11, 2019 (Feb. 11, 2019), vol. 2019, p. 1-13.

Van Blarcom, Thomas et al, "Productive common light chain libraries yield diverse panels of high affinity bispecific antibodies", MABS,vol. 10, No. 2, Dec. 14, 2017 (Dec. 14, 2017), p. 256-268.

Hedvat Michael et al, "697?Tumor-targeted CD28 costimulatory bispecific antibodies enhance T cell activation in solid tumors", Journal for Immunotherapy of Cancer, vol. 8, No. Suppl 3, Nov. 1, 2020 (Nov. 1, 2020), p. A739-A739.

Liu et al., Tumor-targeted CD28 bispecific POWERbody ◌ for safe and synergistic T cell-mediated immunotherapy., 2022 AACR Annual Meeting, Abstract No. 2888 (poster).

Liu et al., Abstract 2888: Tumor-targeted CD28 bispecific POWERbody ○ for safe and synergistic T cell-mediated immunotherapy., Cancer Res (2022) 82 (12_Supplement): 2888.

Ahmed et al., Humanized Affinity-matured Monoclonal Antibody 8H9 Has Potent Antitumor Activity and Binds to FG Loop of Tumor Antigen B7-H3*., The Journal of Biological Chemistry vol. 290, No. 50, pp. 30018-30029, Dec. 11, 2015.

Bohlen et al., Cytolysis of Leukemic B-Cells by T-Cells Activated via Two Bispecific Antibodies., Cancer Research 53, 4310-4314, Sep. 15, 1993.

(56) References Cited

OTHER PUBLICATIONS

Correnti et al., Simultaneous multiple interaction T-cell engaging (SMITE) bispecific antibodies overcome bispecific T-cell engager (BiTE) resistance via CD28 co-stimulation., Leukemia (2018) 32:1239-1243.

Hodge et al., Induction of Antitumor Immunity by Recombinant Vaccinia Viruses Expressing B7-1 or B7-2 Costimulatory Molecules., Cancer Research 54, 5552-5555, Nov. 1, 1994.

Hui et al., T cell costimulatory receptor CD28 is a primary target for PD-1-mediated inhibition., Science 10.1126/science.aaf1292, Mar. 9, 2017.

Jansen et al., An intra-tumoral niche maintains and differentiates stem-like CD8 T cells., Nature vol. 576, pp. 465-470 (2019).

Kamphorst et al., Rescue of exhausted CD8 T cells by PD-1-targeted therapies is CD28-dependent., Science 10.1126/science.aaf0683, Mar. 9, 2017.

Loo et al., Development of an Fc-Enhanced Anti-B7-H3 Monoclonal Antibody with Potent Antitumor Activity., Clin Cancer Res; 18(14) Jul. 15, 2012.

Mary et al., Antagonist properties of monoclonal antibodies targeting human CD28: role of valency and the heavy-chain constant domain., MAbs. Jan.-Feb. 2013;5(1):47-55. doi: 10.4161/mabs.22697. Epub Dec. 5, 2012.

Poirier et al., Advantages of Papio anubis for preclinical testing of immunotoxicity of candidate therapeutic antagonist antibodies targeting CD28., mAbs, 6:3, 697-706, DOI: 10.4161/mabs.28375.

Poirier et al., First-in-Human Study in Healthy Subjects with FR104, a Pegylated Monoclonal Antibody Fragment Antagonist of CD28., J Immunol. Dec. 15, 2016;197(12):4593-4602. doi: 10.4049/jimmunol. 1601538. Epub Nov. 14, 2016.

Seaman et al., Genes that Distinguish Physiological and Pathological Angiogenesis., Cancer Cell. Jun. 2007;11(6):539-54. doi: 10.1016/j.ccr.2007.04.017.

Seamen et al., Eradication of Tumors through Simultaneous Ablation of CD276/B7-H3-Positive Tumor Cells and Tumor Vasculature., Cancer Cell 31, 501-515, Apr. 10, 2017.

Shiao et al., Immunomodulatory Properties of FK734, a Humanized Anti-CD28 Monoclonal Antibody With Agonistic and Antagonistic Activities., Transplantation. Feb. 15, 2007;83(3):304-13. doi: 10.1097/01.tp.0000251426.46312.d5.

Skokos et al., A class of costimulatory CD28-bispecific antibodies that enhance the antitumor activity of CD3-bispecific antibodies., Sci Transl Med. Jan. 8, 2020;12(525):eaaw7888. doi: 10.1126/scitranslmed.aaw7888.

Stebbings et al., After TGN1412: Recent developments in cytokine release assays., J Immunotoxicol. Jan. 2013; 10(1): 75-82.

Waite et al., Tumor-targeted CD28 bispecific antibodies enhance the antitumor efficacy of PD-1 immunotherapy., Sci. Transl. Med. 12, eaba2325 (2020).

Mccarthy et al. Altering the fine specificity of an anti-Legionella single chain antibody by a single amino acid insertion., J. Immunol. Methods, 251(1-2): 137-149, 2001.

Lin et al. Improved affinity of a chicken single-chain antibody to avian infectious bronchitis virus by site-directed mutagenesis of complementarity-determining region H3., African Journal of Biotechnology, 10(79): 18294-18302, 2011.

Yu, Ph.D, Hangxing, Analyzing antibody sequence for recombinant antibody expression. GenScript, May 20, 2015.

Bluemel et al., Epitope distance to the target cell membrane and antigen size determine the potency of T cell-mediated lysis by BiTE antibodies specific for a large melanoma surface antigen., Cancer Immunol Immunother. Aug. 2010;59(8):1197-209. doi: 10.1007/s00262-010-0844-y. Epub Mar. 23, 2010.

Moore et al., A robust heterodimeric Fc platform engineered for efficient development of bispecific antibodies of multiple formats., Methods. Feb. 1, 2019;154:38-50. doi:10.1016/j.ymeth.2018.10.006. Epub Oct. 23, 2018.

Brinkmann et al., The making of bispecific antibodies", MABS, vol. 9, No. 2, Jan. 10, 2017 (Jan. 10, 2017), pp. 182-212".

Moore, Gregory et al., Abstract 1880: PDLI-targeted CD28 costimulatory bispecific antibodies enhance T cell activation in solid tumors., Cancer Research, Jul. 1, 2021 (Jul. 1, 2021), XP055881520, Retrieved from the Internet: URL:https://cancerres.aacrjournals.org/content/81/13_Supplement/1880.

Moore, Gregory et al., PDLI-targeted CD28 costimulatory bispecific antibodies enhance T cell activation in solid tumors., Jul. 1, 2021 (Jul. 1, 2021), XP055881523, Retrieved from the Internet: URL:https://investors.xencor.com/static-files/5adc4e21-6760-4eec-b7b3-f2b6765bddc3.

Almagro et al., Humanization of antibodies. Front Biosci. Jan. 1, 2008 ; 13:1619-33. (Year: 2008).

Kussie et al. A single engineered amino acid substitution changes antibody fine specificity.J Immunol .Jan. 1, 1994 ;152(1 ): 146-52. (Year: 1994).

Edwards et al. The remarkable flexibility of the human antibody repertoire;isolation of over one thousand different antibodies to a single protein,BLyS. J Mol Biol Nov. 14, 2003;334(1):103-18. (Year: 2003).

Mullard, Asher, Trispecific antibodies take to the clinic., Nature Reviews Drug Discovery, Nature, Publishing Group, GB, vol. 19, No. 10, Sep. 11, 2020 (Sep. 11, 2020), pp. 657-658.

Singh et al., Overcoming the challenges associated with CD3+ T-cell redirection in cancer., Br J Cancer. Mar. 16, 2021; 124(6): 1037-1048.

Majocchi et al., Abstract 2884: Optimized CD28 bispecific antibodies for targeted activation of T cells within the tumor microenvironment., Cancer Res (2022) 82 (12_Supplement): 2884.

Poirier et al., CD28-Specific Immunomodulating Antibodies: What Can Be Learned From Experimental Models?: CD28-Specific Immunomodulating Antibodies., American Journal of Transplantation, vol. 12, No. 7, Jul. 1, 2012 (Jul. 1, 2012), pp. 1682-1690, XP055590905, DK ISSN: 1600-6135, DOI: 10.1111 /j.1600-6143.2012.04032.x.

Liu et al., Bispecific antibody targeting TROP2×CD3 suppresses tumor growth of triple negative breast cancer., J Immunother Cancer. Oct. 2021;9(10):e003468. doi: 10.1136/jitc-2021-003468.

Elshiaty et al., Principles and Current Clinical Landscape of Multispecific Antibodies against Cancer., Int J Mol Sci. May 26, 2021;22(11):5632. doi: 10.3390/ijms22115632.

Zeng et al., 1073 Costimulatory CD28 trispecific antibodies targeting PDL1 and PDL2 enhance T cell activation in solid tumors., Journal for Immunotherapy of Cancer, vol. 10, No. Suppl 2,Nov. 1, 2022 (Nov. 1, 2022), p. A1115, XP093064655.

Jin Yixin et al: "Development of STEAP1 targeting chimeric antigen receptor for adoptive cell therapy against cancer", Molecular Therapy—Oncolytics, [Online] vol. 26, Sep. 15, 2022 (Sep. 15, 2022), pp. 189-206.

Bhatia Vipul et al: "Targeting advanced prostate cancer with STEAP1 chimeric antigen receptor T cell therapy", bioRxiv, May 17, 2022 (May 17, 2022), pp. 1-47, XP093203200.

Dragovich Matthew A. et al: "Abstract 2983: Tumor-specific CD28 costimulatory bispecific antibodies enhance T cell activation in solid tumors", Cancer Research, vol. 83, No. 7_Supplement, Apr. 4, 2023 (Apr. 4, 2023), pp. 2983-2983, XP093184059.

Warwas Karsten M. et al: "Co-Stimulatory Bispecific Antibodies Induce Enhanced T Cell Activation and Tumor Cell Killing in Breast Cancer Models", Frontiers in Immunology, vol. 12, Aug. 16, 2021 (Aug. 16, 2021), XP093070636.

Brandl Martina et al: "Bispecific antibody fragments with CD20×CD28 specificity allow effective autologous and allogeneic T-cell activation against malignant cells in peripheral blood and bone marrow cultures from patients with B-cell lineage leukemia and lymphoma", Experimental Hematology, vol. 27, Issue 8, 1264-1270, May 19, 1999 (May 19, 1999).

Otz, T., Große-Hovest, L., Hofmann, M. et al. A bispecific single-chain antibody that mediates target cell-restricted, supra-agonistic CD28 stimulation and killing of lymphoma cells. Leukemia 23, 71-77 (2009). https://doi.org/10.1038/leu.2008.271.

Yao et al., Trispecific antibodies for cancer immunotherapy., Cancer Research, vol. 169, No. 4, Mar. 1, 2023 (Mar. 1, 2023), pp. 389-399, XP93064966.

(56) References Cited

OTHER PUBLICATIONS

Kuchnio et al., Characterization of JNJ-80948543, a Novel CD79b×CD20×CD3 Trispecific T-Cell Redirecting Antibody for the Treatment of B-Cell Non-Hodgkin Lymphoma., Blood (2022) 140 (Supplement 1): 3105-3106., https://doi.org/10.1182/blood-2022-168739.
Dong et al., Novel bispecific antibody-drug conjugate targeting PD-L1 and B7-H3 enhances antitumor efficacy and promotes immune-mediated antitumor responses., Journal for ImmunoTherapy of Cancer 2024;12:e009710.
Katsumata et al., Abstract 4891: Ifinatamab deruxtecan (I-DXd), a novel B7-H3-targeting antibody-drug conjugate, demonstrates efficient payload delivery into tumor through target-dependent internalization., Cancer Res (2023) 83 (7_Supplement): 4891.
Owonikoko et al., IDeate-Lung02: A phase 3, randomized, open-label study of ifinatamab deruxtecan (I-DXd) vs treatment of physician's choice (TPC) in relapsed small cell lung cancer (SCLC)., Meeting Abstract: 2024 ASCO Annual Meeting I J Clin Oncol 42, TPS8126-TPS8126(2024).
Xie et al., ARTEMIS-002: Phase 2 study of HS-20093 in patients with relapsed or refractory osteosarcoma., Meeting Abstract: 2024 ASCO Annual Meeting I J Clin Oncol 42, 11507(2024).
Saif et al. A phase 1 dose escalation/expansion study of GSK5764227 (GSK'227), a B7-homolog 3 (B7-H3) protein targeted antibody-drug conjugate (ADC), in patients with advanced solid tumors, including gastrointestinal (GI) cancers., Meeting Abstract: 2025 ASCO Gastrointestinal Cancers Symposium | J Clin Oncol 43, TPS847-TPS847(2025).
Ma et al., A B7H3-targeting antibody-drug conjugate in advanced solid tumors: a phase 1/1b trial., Nature Medicine vol. 31, pp. 1949-1957 (2025).
Moore et al., A B7-H3-Targeted CD28 Bispecific Antibody Enhances the Activity of Anti-PD-1 and CD3 T-cell Engager Immunotherapies., Mol Cancer Ther. Mar. 4, 2025;24(3):331-344.
Brignole et al., Antitumor activity of the investigational B7-H3 antibody-drug conjugate, vobramitamab duocarmazine, in preclinical models of neuroblastoma., J Immunother Cancer. Sep. 2023;11(9):e007174.
Rudin et al., P2.16-06 A Phase 2 Study of Ifinatamab Deruxtecan (I-DXd; DS-7300) in Patients with Previously Treated ES-SCLC., Journal of Thoracic Oncology, vol. 18, Issue 11, S377.
Patel et al., 690P Ifinatamab deruxtecan (I-DXd; DS-7300) in patients with advanced solid tumors: Updated clinical and biomarker results from a phase I/II study., vol. 34, Supplement 2S481-S482 Oct. 2023.
Schjesvold et al., First-in-Human Phase 1 Study of SAR442257 in Patients with Relapsed/Refractory Multiple Myeloma and Non-Hodgkin Lymphoma., Blood (2024) 144 (Supplement 1): 1992.
Martin-Sanchez et al., Targeting CD38 with isatuximab and a novel CD38/CD3×CD28 trispecific T-cell engager in older patients with acute myeloid leukemia., Blood Adv. Aug. 13, 2024;8(15):3875-3879.
Kaur et al., Potency-optimized CD28-activating bispecific antibody for the targeted treatment of Nectin-4 positive cancers., J Immunother Cancer. Apr. 5, 2025;13(4):e011323.
Grab et al., Pre-Clinical Assessment of SAR442257, a CD38/CD3×CD28 Trispecific T Cell Engager in Treatment of Relapsed/Refractory Multiple Myeloma., Cells. May 20, 2024;13(10):879.
Holzmayer et al., The bispecific B7H3×CD3 antibody CC-3 induces T cell immunity against bone and soft tissue sarcomas., Front. Immunol., May 2, 2024, vol. 15—2024.
Wei et al., CD22-targeted CD28 bispecific antibody enhances antitumor efficacy of odronextamab in refractory diffuse large B cell lymphoma models., Sci Transl Med. Nov. 9, 2022;14(670):eabn1082.
Minchom et al., A phase I/IIa first-in-human clinical trial evaluating MDX2001, a multi-specific antibody in patients with advanced solid tumor malignancies., Annals of Oncology S530, vol. 35, Issue S2, 2024.
Liang et al., A CLDN18.2-Targeting Bispecific T Cell Co-Stimulatory Activator for Cancer Immunotherapy., Cancer Management and Research 2021:13 6977-6987.
Chen et al., A trispecific antibody induces potent tumor-directed T-cell activation and antitumor activity by CD3/CD28 co-engagement., Immunotherapy (2024) 16(3), 143-159.
Abrams et al., Quantitative systems pharmacology modeling sheds light into the dose response relationship of a trispecific T cell engager in multiple myeloma., Scientific Reports (2022) 12:10976.
Elsayed et al., Generation of a novel fully human non-superagonistic anti-CD28 antibody with efficient and safe T-cell co-stimulation properties., mAbs, 15:1, 2220839.
Sun et al., Leveraging T cell co-stimulation for enhanced therapeutic efficacy of trispecific antibodies targeting prostate cancer. Journal for Immuno Therapy of Cancer 2025;13:e010140.
Majocchi et al., Generation of FcRH5×CD28 Bispecific Antibodies Synergizing with T-Cell Engagers for Enhanced Multiple Myeloma Treatment., Blood 144 (2024) 2796.
Majochhi et al., NI-3201 Is a Bispecific Antibody Mediating PD-L1-Dependent CD28 Co-stimulation on T Cells for Enhanced Tumor Control., Cancer Immunol Res 2025;13:365-83.
Goncalves et al., Reversal of Endothelial Cell Anergy by T Cell-Engaging Bispecific Antibodies. Cancers 2024, 16, 4251.
Johannes et al., CD19-CD28: an affinity-optimized CD28 agonist for combination with glofitamab (CD20-TCB) as off-the-shelf immunotherapy., Blood, May 23, 2024, vol. 143, No. 21, p. 2165.
Siddiqui et al., A phase 1/2 study of nezastomig (anti-PSMA3CD28) with or without cemiplimab(anti-PD-1) in patients (pts) with metastatic castration-resistant prostate cancer (mCRPC) and clear cell renal cell carcinoma (ccRCC). J Clin Oncol 43, TPS293(2025.
Xu et al., 1287 Preclinical characterization of MDX2001, a novel tetraspecific T cell engager (CD3/CD28) targeting TROP2 and c-MET in solid tumor malignancies., Novel Single-Agent Immunotherapies , Society for Immunotherapy Cancer, Nov. 5, 2024.

* cited by examiner

Figure 1

Human CD28 sequence SEQ ID NO:757

>sp|P10747|CD28_HUMAN T-cell-specific surface glycoprotein CD28 OS=Homo sapiens OX=9606 GN=CD28 PE=1 SV=1

MLRLLLALNLFPSIQVTGNKILVKQSPMLVAYDNAVNLSCKYSYNLFSREFRASLHKGLDSAVEVCVVYGNYSQQLQ
VYSKTGFNCDGKLGNESVTFYLQNLYVNQTDIYFCKIEVMYPPPYLDNEKSNGTIIHVKGKHLCPSPLFPGPSKPFW
VLVVVGGVLACYSLLVTVAFIIFWVRSKRSRLLHSDYMNMTPRRPGPTRKHYQPYAPPRDFAAYRS

Human CD28, extracellular domain SEQ ID NO:758

>sp|P10747|19-152

NKILVKQSPMLVAYDNAVNLSCKYSYNLFSREFRASLHKGLDSAVEVCVVYGNYSQQLQVYSKTGFNCDGKLGNESV
TFYLQNLYVNQTDIYFCKIEVMYPPPYLDNEKSNGTIIHVKGKHLCPSPLFPGPSKP

Mouse CD28 sequence SEQ ID NO:759

>sp|P31041|CD28_MOUSE T-cell-specific surface glycoprotein CD28 OS=Mus musculus OX=10090 GN=Cd28 PE=1 SV=2

MTLRLLFLALNFFSVQVTENKILVKQSPLLVVDSNEVSLSCRYSYNLLAKEFRASLYKGVNSDVEVCVGNGNFTYQP
QFRSNAEFNCDGDFDNETVTFRLWNLHVNHTDIYFCKIEFMYPPPYLDNERSNGTIIHIKEKHLCHTQSSPKLFWAL
VVVAGVLFCYGLLVTVALCVIWTNSRRNRLLQSDYMNMTPRRPGLTRKPYQPYAPARDFAAYRP

Mouse CD28, extracellular domain SEQ ID NO:760

>sp|P31041|20-150

NKILVKQSPLLVVDSNEVSLSCRYSYNLLAKEFRASLYKGVNSDVEVCVGNGNFTYQPQFRSNAEFNCDGDFDNETV
TFRLWNLHVNHTDIYFCKIEFMYPPPYLDNERSNGTIIHIKEKHLCHTQSSPKL

Cynomolgus CD28 sequence SEQ ID NO:761

>tr|Q0PDN3|Q0PDN3_MACFA CD28 OS=Macaca fascicularis OX=9541 GN=CD28 PE=2 SV=1

MLRLLLALNLLPSIQVTGNKILVKQSPMLVAYDNAVNLSCKYSYNLFSREFRASLHKGLDSAVEVCVVYGNYSQQLQ
VYSKTGFNCDGKLGNESVTFYLQNLYVNQTDIYFCKIEVMYPPPYLDNEKSNGTIIHVKGKHLCPSPLFPGPSKPFW
ALVVVGGVLACYSLLVTVAFCIFWMRSKRSRLLHSDYMNMTPRRPGPTRKHYQPYAPPRDFAAYRS

Cynomolgus CD28, extracellular domain SEQ ID NO:762

>tr|Q0PDN3|19-152

NKILVKQSPMLVAYDNAVNLSCKYSYNLFSREFRASLHKGLDSAVEVCVVYGNYSQQLQVYSKTGFNCDGKLGNESV
TFYLQNLYVNQTDIYFCKIEVMYPPPYLDNEKSNGTIIHVKGKHLCPSPLFPGPSKP

Figure 2A

Human B7H3 sequence SEQ ID NO:763

>sp|Q5ZPR3|CD276_HUMAN CD276 antigen OS=Homo sapiens OX=9606 GN=CD276 PE=1 SV=1

MLRRRGSPGMGVHVGAALGALWFCLTGALEVQVPEDPVVALVGTDATLCCSFSPEPGFSLAQLNLIWQLTDTKQLVH
SFAEGQDQGSAYANRTALFPDLLAQGNASLRLQRVRVADEGSFTCFVSIRDFGSAAVSLQVAAPYSKPSMTLEPNKD
LRPGDTVTITCSSYQGYPEAEVFWQDGQGVPLTGNVTTSQMANEQGLFDVHSILRVVLGANGTYSCLVRNPVLQQDA
HSSVTITPQRSPTGAVEVQVPEDPVVALVGTDATLRCSFSPEPGFSLAQLNLIWQLTDTKQLVHSFTEGRDQGSAYA
NRTALFPDLLAQGNASLRLQRVRVADEGSFTCFVSIRDFGSAAVSLQVAAPYSKPSMTLEPNKDLRPGDTVTITCSS
YRGYPEAEVFWQDGQGVPLTGNVTTSQMANEQGLFDVHSVLRVVLGANGTYSCLVRNPVLQQDAHGSVTITGQPMTF
PPEALWVTVGLSVCLIALLVALAFVCWRKIKQSCEEENAGAEDQDGEGEGSKTALQPLKHSDSKEDDGQEIA

Human B7H3, extracellular domain SEQ ID NO:764

>sp|Q5ZPR3|29-466

LEVQVPEDPVVALVGTDATsLCCSFSPEPGFSLAQLNLIWQLTDTKQLVHSFAEGQDQGSAYANRTALFPDLLAQGN
ASLRLQRVRVADEGSFTCFVSIRDFGSAAVSLQVAAPYSKPSMTLEPNKDLRPGDTVTITCSSYQGYPEAEVFWQDG
QGVPLTGNVTTSQMANEQGLFDVHSILRVVLGANGTYSCLVRNPVLQQDAHSSVTITPQRSPTGAVEVQVPEDPVVA
LVGTDATLRCSFSPEPGFSLAQLNLIWQLTDTKQLVHSFTEGRDQGSAYANRTALFPDLLAQGNASLRLQRVRVADE
GSFTCFVSIRDFGSAAVSLQVAAPYSKPSMTLEPNKDLRPGDTVTITCSSYRGYPEAEVFWQDGQGVPLTGNVTTSQ
MANEQGLFDVHSVLRVVLGANGTYSCLVRNPVLQQDAHGSVTITGQPMTFPPEA

Human B7H3, V1C1 domain SEQ ID NO:765

LEVQVPEDPVVALVGTDATLCCSFSPEPGFSLAQLNLIWQLTDTKQLVHSFAEGQDQGSAYANRTALFPDLLAQGNA
SLRLQRVRVADEGSFTCFVSIRDFGSAAVSLQVA

Human B7H3, V2C2 domain SEQ ID NO:766

PTGAVEVQVPEDPVVALVGTDATLRCSFSPEPGFSLAQLNLIWQLTDTKQLVHSFTEGRDQGSAYANRTALFPDLLA
QGNASLRLQRVRVADEGSFTCFVSIRDFGSAAVSLQVAAPYSKPSMTLEPNKDLRPGDTVTITCSSYRGYPEAEVFW
QDGQGVPLTGNVTTSQMANEQGLFDVHSVLRVVLGANGTYSCLVRNPVLQQDAHGSVTIT

Mouse B7H3 sequence SEQ ID NO:767

>sp|Q8VE98|CD276_MOUSE CD276 antigen OS=Mus musculus OX=10090 GN=Cd276 PE=1 SV=1

MLRGWGGPSVGVCVRTALGVLCLCLTGAVEVQVSEDPVVALVDTDATLRCSFSPEPGFSLAQLNLIWQLTDTKQLVH
SFTEGRDQGSAYSNRTALFPDLLVQGNASLRLQRVRVTDEGSYTCFVSIQDFDSAAVSLQVAAPYSKPSMTLEPNKD
LRPGNMVTITCSSYQGYPEAEVFWKDGQGVPLTGNVTTSQMANERGLFDVHSVLRVVLGANGTYSCLVRNPVLQQDA
HGSVTITGQPLTFPPEALWVTVGLSVCLVVLLVALAFVCWRKIKQSCEEENAGAEDQDGDGEGSKTALRPLKPSENK
EDDGQEIA

Mouse B7H3, extracellular domain SEQ ID NO:768

>sp|Q8VE98|29-248

VEVQVSEDPVVALVDTDATLRCSFSPEPGFSLAQLNLIWQLTDTKQLVHSFTEGRDQGSAYSNRTALFPDLLVQGNA
SLRLQRVRVTDEGSYTCFVSIQDFDSAAVSLQVAAPYSKPSMTLEPNKDLRPGNMVTITCSSYQGYPEAEVFWKDGQ
GVPLTGNVTTSQMANERGLFDVHSVLRVVLGANGTYSCLVRNPVLQQDAHGSVTITGQPLTFPPEA

Figure 2B

Cynomolgus CD28 sequence (predicted) SEQ ID NO:769

>XP_015308533.1 PREDICTED: CD276 antigen isoform X1 [Macaca fascicularis]

MKLSSDHVFPLFRKLQWLPAAFRIQFTPVSPSAGAAFHHGEPSCQLPHSKMLHRRGSPGMGVHVGAALGALWFCLTG
ALEVQVPEDPVVALVGTDATLRCSFSPEPGFSLAQLNLIWQLTDTKQLVHSFTEGRDQGSAYANRTALFLDLLAQGN
ASLRLQRVRVADEGSFTCFVSIRDFGSAAVSLQVAAPYSKPSMTLEPNKDLRPGDTVTITCSSYRGYPEAEVFWQDG
QGAPLTGNVTTSQMANEQGLFDVHSVLRVVLGANGTYSCLVRNPVLQQDAHGSITITPQRSPTGAVEVQVPEDPVVA
LVGTDATLRCSFSPEPGFSLAQLNLIWQLTDTKQLVHSFTEGRDQGSAYANRTALFLDLLAQGNASLRLQRVRVADE
GSFTCFVSIRDFGSAAVSLQVAAPYSKPSMTLEPNKDLRPGDTVTITCSSYRGYPEAEVFWQDGQGAPLTGNVTTSQ
MANEQGLFDVHSVLRVVLGANGTYSCLVRNPVLQQDAHGSVTITGQPMTFPPEALWVTVGLSVCLVALLVALAFVCW
RKIKQSCEEENAGAEDQDGEGEGSKTALQPLKHSDSKEDDGQELA

Cynomolgus CD28, extracellular domain SEQ ID NO:770

>XP_015308533.1|79-516

LEVQVPEDPVVALVGTDATLRCSFSPEPGFSLAQLNLIWQLTDTKQLVHSFTEGRDQGSAYANRTALFLDLLAQGNA
SLRLQRVRVADEGSFTCFVSIRDFGSAAVSLQVAAPYSKPSMTLEPNKDLRPGDTVTITCSSYRGYPEAEVFWQDGQ
GAPLTGNVTTSQMANEQGLFDVHSVLRVVLGANGTYSCLVRNPVLQQDAHGSITITPQRSPTGAVEVQVPEDPVVAL
VGTDATLRCSFSPEPGFSLAQLNLIWQLTDTKQLVHSFTEGRDQGSAYANRTALFLDLLAQGNASLRLQRVRVADEG
SFTCFVSIRDFGSAAVSLQVAAPYSKPSMTLEPNKDLRPGDTVTITCSSYRGYPEAEVFWQDGQGAPLTGNVTTSQM
ANEQGLFDVHSVLRVVLGANGTYSCLVRNPVLQQDAHGSVTITGQPMTFPPEA

Figure 3A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 3B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 3C

| **Monomer 1** | **Monomer 2** |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 3D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 3E

| Monomer 1 | Monomer 2 |
|---|---|
| K392D/K409D | E356K/D399K |
| K370D/K392D/K409D | E356K/E357K/D399K |
| K274Q/R355Q/N384S/K392N/V397M/Q419E/K447_ | P217R/P228R/N276K |
| K274Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| K274Q/R355Q/Q419E/K447_ | P217R/P228R/N276K |
| K274Q/R355Q/Q419E/K447_ | N276K |
| I199T/N203D/K274Q/R355Q/N384S/K392N/V397M/Q419E/K447_ | Q196K/I199T/P217R/P228R/N276K |
| I199T/N203D/K274Q/R355Q/N384S/K392N/V397M/Q419E/K447_ | Q196K/I199T/N276K |
| I199T/N203D/K274Q/R355Q/Q419E/K447_ | Q196K/I199T/P217R/P228R/N276K |
| I199T/N203D/K274Q/R355Q/Q419E/K447_ | Q196K/I199T/N276K |

Figure 3F

| Monomer 1 | Monomer 2 |
|---|---|
| I199T/N203D/K274Q/R355Q/N384S/K392N/V397M/Q419E/K447_ | |
| N208D/Q295E/N384D/Q418E/N421D | |
| N208D/Q295E/Q418E/N421D | |
| Q196K/I199T/P217R/P228R/N276K | |
| Q196K/I199T/N276K | |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 4

| Variant constant region | Substitutions |
|---|---|
| pI-ISO(-) | I199T/N203D/K274Q/R355Q/N384S/K392N/N397M/Q418E/K447_ |
| pI_ISO(-)-Fc only | K274Q/R355Q/N384S/K392N/V397M/Q418E/K447_ |
| pI_(-)_isosteric_A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 5

Ablation Variants

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | SEQ ID NO:771 |
| Whitlow linker | GSTSGSGKPGSGEGSTKG | 18 | +1 | SEQ ID NO:772 |
| 6paxA_1 (+A) | IRPRAIGGSKPRVA | 14 | +4 | SEQ ID NO:773 |
| +B | GKGGSGKGGSGKGGS | 15 | +3 | SEQ ID NO:774 |
| +C | GGKGSGGKGSGGKGS | 15 | +3 | SEQ ID NO:775 |
| +D | GGGKSGGGKSGGGKS | 15 | +3 | SEQ ID NO:776 |
| +E | GKGKSGKGKSGKGKS | 15 | +6 | SEQ ID NO:777 |
| +F | GGGKSGGKGSGKGGS | 15 | +3 | SEQ ID NO:778 |
| +G | GKPGSGKPGSGKPGS | 15 | +3 | SEQ ID NO:779 |
| +H | GKPGSGKPGSGKPGSGKPGS | 20 | +4 | SEQ ID NO:780 |
| +I | GKGKSGKGKSGKGKSGKGKS | 20 | +8 | SEQ ID NO:781 |

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | SEQ ID NO:782 |
| 3hsc_2 (-A) | STAGDTHLGGEDFD | 14 | -4 | SEQ ID NO:783 |
| -B | GEGGSGEGGSGEGGS | 15 | -3 | SEQ ID NO:784 |
| -C | GGEGSGGEGSGGEGS | 15 | -3 | SEQ ID NO:785 |
| -D | GGGESGGGESGGGES | 15 | -3 | SEQ ID NO:786 |
| -E | GEGESGEGESGEGES | 15 | -6 | SEQ ID NO:787 |
| -F | GGGESGGEGSGEGGS | 15 | -3 | SEQ ID NO:788 |
| -G | GEGESGEGESGEGESGEGES | 20 | -8 | SEQ ID NO:789 |

Additional scFv Linkers

| Sequence | SEQ ID NO |
|---|---|
| GGGGSGGGGSGGGGS | SEQ ID NO:790 |
| GGGGSGGGGSGGGGSGGGGS | SEQ ID NO:791 |
| GSTSGSGKPGSGEGSTKG | SEQ ID NO:792 |
| PRGASKSGSASQTGSAPGS | SEQ ID NO:793 |
| GTAAAGAGAAGGAAAGAAG | SEQ ID NO:794 |
| GTSGSSGSGSGGSGSGGGG | SEQ ID NO:795 |
| GKPGSGKPGSGKPGSGKPGS | SEQ ID NO:796 |

Figure 7

Useful domain linkers

| Name | Sequence | SEQ ID NO: |
|---|---|---|
| $(GGGGS)_1$ or GGGGS | GGGGS | SEQ ID NO:797 |
| $(GGGGS)_2$ | GGGGSGGGGS | SEQ ID NO:798 |
| $(GGGGS)_3$ | GGGGSGGGGSGGGGS | SEQ ID NO:799 |
| $(GGGGS)_4$ | GGGGSGGGGSGGGGSGGGGS | SEQ ID NO:800 |
| $(GGGGS)_5$ | GGGGSGGGGSGGGGSGGGGSGGGGS | SEQ ID NO:801 |
| $(GGGGS)_6$ | GGGGSGGGGSGGGGSGGGGSGGGGSGGGGS | SEQ ID NO:802 |
| $(GGGGS)_7$ | GGGGSGGGGSGGGGSGGGGSGGGGSGGGGSGGGGS | SEQ ID NO:803 |
| $(GGGGA)_1$ or GGGGA | GGGGA | SEQ ID NO:804 |
| $(GGGGA)_2$ | GGGGAGGGGA | SEQ ID NO:805 |
| $(GGGGA)_3$ | GGGGAGGGGAGGGGA | SEQ ID NO:806 |
| $(GGGGA)_4$ | GGGGAGGGGAGGGGAGGGGA | SEQ ID NO:807 |
| $(GGGGA)_5$ | GGGGAGGGGAGGGGAGGGGAGGGGA | SEQ ID NO:808 |
| $(GGGGA)_6$ | GGGGAGGGGAGGGGAGGGGAGGGGAGGGGA | SEQ ID NO:809 |
| $(GGGGA)_7$ | GGGGAGGGGAGGGGAGGGGAGGGGAGGGGAGGGGA | SEQ ID NO:810 |
| 30AA-linker | DPALVHQRPAPPGGGGSGGGGSGGGGSGGG | SEQ ID NO:811 |
| $(GKPGS)_1$ or GKPGS | GKPGS | SEQ ID NO:812 |
| $(GKPGS)_5$ | GKPGSGKPGSGKPGSGKPGSGKPGS | SEQ ID NO:813 |
| $(GKPGS)_6$ | GKPGSGKPGSGKPGSGKPGSGKPGSGKPGS | SEQ ID NO:814 |
| $(GGGES)_1$ or GGGES | GGGES | SEQ ID NO:815 |
| “lower half hinge” | KTHTCPPCP | SEQ ID NO:816 |
| “full hinge C220S variant” | EPKSSDKTHTCPPCP | SEQ ID NO:817 |
| “flex lower half hinge” | GGGGSGGGGSKTHTCPPCP | SEQ ID NO:818 |
| “charged lower half hinge1” | GKPGSGKPGSKTHTCPPCP | SEQ ID NO:819 |
| “charged lower half hinge2” | GKPGSKTHTCPPCP | SEQ ID NO:820 |
| “upper half hinge” | EPKSC | SEQ ID NO:821 |
| “flex upper half hinge” | EPKSCGGGGSGGGGS | SEQ ID NO:822 |
| “charged upper half hinge1” | EPKSCGKPGSGKPGS | SEQ ID NO:1182 |
| “charged upper half hinge2” | EPKSCGKPGS | SEQ ID NO:1183 |

Figure 8

| **Monomer 1 (-)** | **Monomer 2 (+)** |
| --- | --- |
| Heterodimer skew variants L368D/K370S | Heterodimer skew variants S364K/E357Q |
| Isosteric pI variant Q295E/N384D/Q418E/N421D | |
| FcKO<br>E233P/L234V/L235A/G236_/S267K | FcKO<br>E233P/L234V/L235A/G236_/S267K |
| ±M428L/N434S for FcRn | ±M428L/N434S for FcRn |

Figure 9

| XENP | Heterodimer-skew variant, Chain 1 | Heterodimer-skew variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

Figure 10A

Heterodimeric Fc Backbone 1

>Heterodimeric Fc Backbone 1 monomer 1 (-) (SEQ ID NO:823)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone 1 monomer 2 (+) (SEQ ID NO:824)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 2

>Heterodimeric Fc Backbone 2 monomer 1 (-) (SEQ ID NO:825)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone monomer 2 (+) (SEQ ID NO:826)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 3

>Heterodimeric Fc Backbone 3 monomer 1 (-) (SEQ ID NO:827)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCEVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone 3 monomer 2 (+) (SEQ ID NO:828)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 4

>Heterodimeric Fc Backbone 4 monomer 1 (-) (SEQ ID NO:829)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTENEVSLTCLVKGFYPSDIAVEWESDG
QPENNYKTTPPVLDSDGSFFLYSKLEVDKSRWEQGDVFSCSVMHEALHNHYTQKSLSLSPGK

>Heterodimeric Fc Backbone 4 monomer 2 (+) (SEQ ID NO:830)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSKGSFFLYSKLTVDKSRWQQGNVFSCSVMHEALHNHYTQKSLSLSPGK

Figure 10B

Heterodimeric Fc Backbone 5

>Heterodimeric Fc Backbone 5 monomer 1 (-) (SEQ ID NO:831)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSRDELTKNQVSLTCDVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone 5 monomer 2 (+) (SEQ ID NO:832)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSRDQLTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 6

>Heterodimeric Fc Backbone 6 monomer 1 (-) (SEQ ID NO:833)
APPVAGPSVFLFPPKPKDTLMISRTPEVTCVVVDVKHEDPEVKFNWYVDGVEVHNAKTKPREEEYASTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone 6 monomer 2 (+) (SEQ ID NO:834)
APPVAGPSVFLFPPKPKDTLMISRTPEVTCVVVDVKHEDPEVKFNWYVDGVEVHNAKTKPREEQYASTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 7

>Heterodimeric Fc Backbone 7 monomer 1 (-) (SEQ ID NO:835)
APPVAGPSVFLFPPKPKDTLMISRTPEVTCVVVDVKHEDPEVKFNWYVDGVEVHNAKTKPREEEYSSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone 7 monomer 2 (+) (SEQ ID NO:836)
APPVAGPSVFLFPPKPKDTLMISRTPEVTCVVVDVKHEDPEVKFNWYVDGVEVHNAKTKPREEQYSSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 8

>Heterodimeric Fc Backbone 8 monomer 1 (-) (SEQ ID NO:837)
APEFLGGPSVFLFPPKPKDTLMISRTPEVTCVVVDVSQEDPEVQFNWYVDGVEVHNAKTKPREEEFNSTYRVVSVLT
VLHQDWLNGKEYKCKVSNKGLPSSIEKTISKAKGQPREPQVYTLPPSQEEMTKNQVSLTCDVSGFYPSDIAVEWESD
GQPENNYKTTPPVLDSDGSFFLYSRLTVDKSRWEEGDVFSCSVMHEALHNHYTQKSLSLSLGK

>Heterodimeric Fc Backbone 8 monomer 2 (+) (SEQ ID NO:838)
APEFLGGPSVFLFPPKPKDTLMISRTPEVTCVVVDVSQEDPEVQFNWYVDGVEVHNAKTKPREEQFNSTYRVVSVLT
VLHQDWLNGKEYKCKVSNKGLPSSIEKTISKAKGQPREPQVYTLPPSQEQMTKNQVKLTCLVKGFYPSDIAVEWESN
GQPENNYKTTPPVLDSDGSFFLYSRLTVDKSRWQEGNVFSCSVMHEALHNHYTQKSLSLSLGK

Figure 10C

Heterodimeric Fc Backbone 9

>Heterodimeric Fc Backbone 9 monomer 1 (-) (SEQ ID NO:839)
APPVAGPSVFLFPPKPKDTLMISRTPEVTCVVVDVSHEDPEVQFNWYVDGVEVHNAKTKPREEEFNSTFRVVSVLTV
VHQDWLNGKEYKCKVSNKGLPAPIEKTISKTKGQPREPQVYTLPPSREEMTKNQVSLTCDVSGFYPSDIAVEWESDG
QPENNYKTTPPMLDSDGSFFLYSKLTVDKSRWEQGDVFSCSVMHEALHNHYTQKSLSLSPGK

>Heterodimeric Fc Backbone 9 monomer 2 (+) (SEQ ID NO:840)
APPVAGPSVFLFPPKPKDTLMISRTPEVTCVVVDVSHEDPEVQFNWYVDGVEVHNAKTKPREEQFNSTFRVVSVLTV
VHQDWLNGKEYKCKVSNKGLPAPIEKTISKTKGQPREPQVYTLPPSREQMTKNQVKLTCLVKGFYPSDIAVEWESNG
QPENNYKTTPPMLDSDGSFFLYSKLTVDKSRWQQGNVFSCSVMHEALHNHYTQKSLSLSPGK

Heterodimeric Fc Backbone 10

>Heterodimeric Fc Backbone 10 monomer 1 (-) (SEQ ID NO:841)
APPVAGPSVFLFPPKPKDTLMISRTPEVTCVVVDVKHEDPEVQFNWYVDGVEVHNAKTKPREEEFNSTFRVVSVLTV
VHQDWLNGKEYKCKVSNKGLPAPIEKTISKTKGQPREPQVYTLPPSREEMTKNQVSLTCDVSGFYPSDIAVEWESDG
QPENNYKTTPPMLDSDGSFFLYSKLTVDKSRWEQGDVFSCSVMHEALHNHYTQKSLSLSPGK

>Heterodimeric Fc Backbone 10 monomer 2 (+) (SEQ ID NO:842)
APPVAGPSVFLFPPKPKDTLMISRTPEVTCVVVDVKHEDPEVQFNWYVDGVEVHNAKTKPREEQFNSTFRVVSVLTV
VHQDWLNGKEYKCKVSNKGLPAPIEKTISKTKGQPREPQVYTLPPSREQMTKNQVKLTCLVKGFYPSDIAVEWESNG
QPENNYKTTPPMLDSDGSFFLYSKLTVDKSRWQQGNVFSCSVMHEALHNHYTQKSLSLSPGK

Heterodimeric Fc Backbone 11

>Heterodimeric Fc Backbone 11 monomer 1 (-) (SEQ ID NO:843)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK

>Heterodimeric Fc Backbone 11 monomer 2 (+) (SEQ ID NO:844)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVLHEALHSHYTQKSLSLSPGK

Heterodimeric Fc Backbone 12

>Heterodimeric Fc Backbone 12 monomer 1 (-) (SEQ ID NO:845)
APPVAGPSVFLFPPKPKDTLMISRTPEVTCVVVDVKHEDPEVKFKWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

>Heterodimeric Fc Backbone 12 monomer 2 (+) (SEQ ID NO:846)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Figure 11

2 + 1 mAb-scFv Heterodimeric Fc Backbone

>2 + 1 mAb-scFv Heterodimeric Fc Backbone monomer 1 (-) (SEQ ID NO:847)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPK

>2 + 1 mAb-scFv Heterodimeric Fc Backbone monomer 2 (+) (SEQ ID NO:848)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSP

Figure 12

IgG1 CH1(+) + hinge (SEQ ID NO:849)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCP

IgG1 CH1(-) + hinge (SEQ ID NO:850)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCP

IgG2 CH1(+) + hinge (SEQ ID NO:851)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSNTKVDKTVERKCCVECPPCP

IgG2 CH1(-) + hinge (SEQ ID NO:852)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPPCP

IgG4 CH1(+) + hinge (SEQ ID NO:853)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSNTKVDKRVESKYGPPCPSCP

IgG4 CH1(-) + hinge (SEQ ID NO:854)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRVESKYGPPCPSCP

Figure 13

IgG1 CH1(+) + half hinge (SEQ ID NO:855)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSC

IgG1 CH1(-) + half hinge (SEQ ID NO:856)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSC

Figure 14

IgG1 CH1(+) (SEQ ID NO:857)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKV

IgG1 CH1(-) (SEQ ID NO:858)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKV

IgG2 CH1(+) (SEQ ID NO:859)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSNTKVDKTV

IgG2 CH1(-) (SEQ ID NO:860)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTV

IgG4 CH1(+) (SEQ ID NO:861)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSNTKVDKRV

IgG4 CH1(-) (SEQ ID NO:862)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRV

Figure 15

IgG1 hinge (SEQ ID NO:863)
EPKSCDKTHTCPPCP

IgG2 hinge (SEQ ID NO:864)
ERKCCVECPPCP

IgG4 hinge (SEQ ID NO:865)
ESKYGPPCPSCP

Figure 16

Light Chain Constant Domain – Kappa (SEQ ID NO: 866)
RTVAAPSVFIFPPSDEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Light Chain Constant Domain – Lambda (SEQ ID NO:867)
GQPKAAPSVTLFPPSSEELQANKATLVCLISDFYPGAVTVAWKADSSPVKAGVETTTPSKQSNNKYAASSYLSLTPE
QWKSHRSYSCQVTHEGSTVEKTVAPTECS

Figure 17

>XENP16432 Nivolumab_H0L0_IgG1_PVA_/S267K

Heavy Chain SEQ ID NO:868
QVQLVESGGGVVQPGRSLRLDCKASGITFSNSGMHWVRQAPGKGLEWVAVIWYDGSKRYYADSVKGRFTISRDNSKN
TLFLQMNSLRAEDTAVYYCATNDDYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK

Light Chain SEQ ID NO:869
EIVLTQSPATLSLSPGERATLSCRASQSVSSYLAWYQQKPGQAPRLLIYDASNRATGIPARFSGSGSGTDFTLTISS
LEPEDFAVYYCQQSSNWPRTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

| | sequence | SEQ ID NO: |
|---|---|---|
| **Variable heavy (vh) domain** | EVQLLESGGGLVQPGGSLRLSCAASGFTFSSYAMSWVRQAPGKGLEWVSTISGSGDSTYYADSVKGRFTISRDNSKNTLYLQMNSLRAEDTAVYYCAKSGPGLRQVGFDYWGQGTLVTVSS | SEQ ID NO:870 |
| **vhCDR1** | SYAMS | SEQ ID NO:871 |
| **vhCDR2** | TISGSGDSTYYADSVKG | SEQ ID NO:872 |
| **vhCDR3** | SGPGLRQVGFDY | SEQ ID NO:873 |
| **Variable light (vl) domain** | DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK | SEQ ID NO:874 |
| **vlCDR1** | RASQSISSYLN | SEQ ID NO:875 |
| **vlCDR2** | AASSLQS | SEQ ID NO:876 |
| **vlCDR3** | QQSYSTPFT | SEQ ID NO:877 |

>XENP28428 1A7[CD28]_H1L1_IgG1_PVA_/S267K

Heavy Chain SEQ ID NO:878
EVQLLESGGGLVQPGGSLRLSCAASGFTFSSYAMSWVRQAPGKGLEWVSTISGSGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

Light Chain SEQ ID NO:879
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 19

| | sequence | SEQ ID NO: |
|---|---|---|
| Variable heavy (vh) domain 1A7_H1.1 | EVQLLESGGGLVQPGGSLRLSCAASGFTFSSYYMSWVRQAPGKGLEWVSTISGSGDSTYYADSVKGRFTISRDNSKNTLYLQMNSLRAEDTAVYYCAKSGPGLRQVGFDYWGQGTLVTVSS | SEQ ID NO:880 |
| vhCDR1 | SYYMS | SEQ ID NO:881 |
| vhCDR2 | TISGSGDSTYYADSVKG | SEQ ID NO:882 |
| vhCDR3 | SGPGLRQVGFDY | SEQ ID NO:883 |

| | sequence | SEQ ID NO: |
|---|---|---|
| Variable heavy (vh) domain 1A7_H1.14 | EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSS | SEQ ID NO:884 |
| vhCDR1 | SYYMS | SEQ ID NO:885 |
| vhCDR2 | TISESGDSTYYADSVKG | SEQ ID NO:886 |
| vhCDR3 | SGPGLRQVGFDY | SEQ ID NO:887 |

Figure 20

| | sequence | SEQ ID NO: |
|---|---|---|
| **Variable heavy (vh) domain 1A7_L1.71** | DIQMTQSPSSLSASVGDRVTITCRASQSISSYLNWYQQKPGKAPKLLIYAASSLQSGVPSRFSGSGSGTDFTLTISSLQPEDFATYYCQQVYSTPFTFGQGTKLEIK | SEQ ID NO:888 |
| **vhCDR1** | RASQSISSYLN | SEQ ID NO:889 |
| **vhCDR2** | AASSLQS | SEQ ID NO:890 |
| **vhCDR3** | QQVYSTPFT | SEQ ID NO:891 |

Figure 21A

| **1A7[CD28]_H1_L1.71** | | |
|---|---|---|
| | Sequence | SEQ ID NO: |
| Variable Heavy (vh) Domain | EVQLLESGGGLVQPGGSLRLSCAASGFTFSSYAMSWVRQAPGKGLEWVSTISGSGDSTYYADSVKGRFTISRDNSKNTLYLQMNSLRAEDTAVYYCAKSGPGLRQVGFDYWGQGTLVTVSS | SEQ ID NO:892 |
| vhCDR1 | SYAMS | SEQ ID NO:893 |
| vhCDR2 | TISGSGDSTYYADSVKG | SEQ ID NO:894 |
| vhCDR3 | SGPGLRQVGFDY | SEQ ID NO:895 |
| Variable Light (vl) Domain | DIQMTQSPSSLSASVGDRVTITCRASQSISSYLNWYQQKPGKAPKLLIYAASSLQSGVPSRFSGSGSGTDFTLTISSLQPEDFATYYCQQVYSTPFTFGQGTKLEIK | SEQ ID NO:896 |
| vlCDR1 | RASQSISSYLN | SEQ ID NO:897 |
| vlCDR2 | AASSLQS | SEQ ID NO:898 |
| vlCDR3 | QQVYSTPFT | SEQ ID NO:899 |

| **1A7[CD28]_H1.1_L1.71** | | |
|---|---|---|
| | Sequence | SEQ ID NO: |
| Variable Heavy (vh) Domain | EVQLLESGGGLVQPGGSLRLSCAASGFTFSSYYMSWVRQAPGKGLEWVSTISGSGDSTYYADSVKGRFTISRDNSKNTLYLQMNSLRAEDTAVYYCAKSGPGLRQVGFDYWGQGTLVTVSS | SEQ ID NO:900 |
| vhCDR1 | SYYMS | SEQ ID NO:901 |
| vhCDR2 | TISGSGDSTYYADSVKG | SEQ ID NO:902 |
| vhCDR3 | SGPGLRQVGFDY | SEQ ID NO:903 |
| Variable Light (vl) Domain | DIQMTQSPSSLSASVGDRVTITCRASQSISSYLNWYQQKPGKAPKLLIYAASSLQSGVPSRFSGSGSGTDFTLTISSLQPEDFATYYCQQVYSTPFTFGQGTKLEIK | SEQ ID NO:904 |
| vlCDR1 | RASQSISSYLN | SEQ ID NO:905 |
| vlCDR2 | AASSLQS | SEQ ID NO:906 |
| vlCDR3 | QQVYSTPFT | SEQ ID NO:907 |

Figure 21B

| 1A7[CD28]_H1.14_L1 | | |
|---|---|---|
| | Sequence | SEQ ID NO: |
| Variable Heavy (vh) Domain | EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSS | SEQ ID NO:908 |
| vhCDR1 | SYYMS | SEQ ID NO:909 |
| vhCDR2 | TISESGDSTYYADSVKG | SEQ ID NO:910 |
| vhCDR3 | SGPGLRQVGFDY | SEQ ID NO:911 |
| Variable Light (vl) Domain | DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK | SEQ ID NO:912 |
| vlCDR1 | RASQSISSYLN | SEQ ID NO:913 |
| vlCDR2 | AASSLQS | SEQ ID NO:914 |
| vlCDR3 | QQSYSTPFT | SEQ ID NO:915 |

| 1A7[CD28]_H1.14_L1.71 | | |
|---|---|---|
| | Sequence | SEQ ID NO: |
| Variable Heavy (vh) Domain | EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSS | SEQ ID NO:916 |
| vhCDR1 | SYYMS | SEQ ID NO:917 |
| vhCDR2 | TISESGDSTYYADSVKG | SEQ ID NO:918 |
| vhCDR3 | SGPGLRQVGFDY | SEQ ID NO:919 |
| Variable Light (vl) Domain | DIQMTQSPSSLSASVGDRVTITCRASQSISSYLNWYQQKPGKAPKLLIYAASSLQSGVPSRFSGSGSGTDFTLTISSLQPEDFATYYCQQVYSTPFTFGQGTKLEIK | SEQ ID NO:920 |
| vlCDR1 | RASQSISSYLN | SEQ ID NO:921 |
| vlCDR2 | AASSLQS | SEQ ID NO:922 |
| vlCDR3 | QQVYSTPFT | SEQ ID NO:923 |

| 1A7 VH/VL Pair | VH SEQ ID NO: | VL SQ ID NO: | scFv Orientation | $K_D$ for human CD28 (nM) |
|---|---|---|---|---|
| L1.71_H1.14 | SEQ ID NO:598 | SEQ ID NO:743 | VLVH | 36.7 (+/- 4.1) |
| H1.14_L1.71 | SEQ ID NO:598 | SEQ ID NO:743 | VHVL | 35(+/- 1.8) |
| H1.1_L1.71 | SEQ ID NO:585 | SEQ ID NO:743 | VHVL | 91.6 (+/-5.7) |
| H1_L1.71 | SEQ ID NO:870 | SEQ ID NO:743 | VHVL | 180(+/-2) |
| L1_H1.14 | SEQ ID NO:598 | SEQ ID NO:874 | VLVH | 286 (+/- 40) |
| H1.14_L1 | SEQ ID NO:598 | SEQ ID NO:874 | VHVL | 229 (+/- 0.4) |

B)

| 1A7 VH/VL Pair | VH SEQ ID NO: | VL SQ ID NO: | | $K_D$ for human CD28 (nM) |
|---|---|---|---|---|
| H1.1_L1 | SEQ ID NO:585 | SEQ ID NO:874 | | 232 (XENP37808) |
| H1.14_L1 | SEQ ID NO:598 | SEQ ID NO:874 | | 62.8 (XENP31398); 200 (XENP37810) |

Figure 23

>XENP27181 HuTN228[CD28]_H1L1_IgG1_PVA_/S267K

Heavy Chain SEQ ID NO:924
QVQLQESGPGLVKPSETLSLTCAVSGFSLTSYGVHWIRQPPGKGLEWLGVIWPGGGTNFNSALMSRLTISEDTSKNQ
VSLKLSSVTAADTAVYYCARDRAYGNYLYAMDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

Light Chain SEQ ID NO:925
DIQMTQSPSSLSASVGDRVTITCRASESVEYYVTSLMQWYQQKPGKAPKLLIYAASNVDSGVPSRFSGSGSGTDFTL
TISSLQPEDIATYYCQQSRKVPFTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP27656 empty-HuTN228[CD28]_H1L1_scFv(GKPGS)4-Fc(216)_IgG1_pI(-)_Isosteric_A_C220S/PVA_/S267K/L368D/K370S-Fc(216)_IgG1_C220S/PVA_/S267K/S364K/E357Q

Chain 1 - empty-Fc(216)_IgG1_pI(-)_Isosteric_A_C220S/PVA_/S267K/L368D/K370S empty-Fc Heavy Chain SEQ ID NO:926
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - HuTN228[CD28]_H1L1_scFv(GKPGS)4-Fc(216)_IgG1_C220S/PVA_/S267K/S364K/E357Q scFv-Fc Heavy Chain SEQ ID NO:927
QVQLQESGPGLVKPSETLSLTCAVSGFSLTSYGVHWIRQPPGKGLEWLGVIWPGGGTNFNSALMSRLTISEDTSKNQ
VSLKLSSVTAADTAVYYCARDRAYGNYLYAMDYWGQGTLVTVSS/GKPGSGKPGSGKPGSGKPGS/DIQMTQSPSSL
SASVGDRVTITCRASESVEYYVTSLMQWYQQKPGKAPKLLIYAASNVDSGVPSRFSGSGSGTDFTLTISSLQPEDIA
TYYCQQSRKVPFTFGGGTKVEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 24

| Phage anti-CD28 Clone | $K_{Dapp}$ (M) |
|---|---|
| Phage Clone A | 3.31E-08 |
| Phage Clone B | 1.76E-08 |
| Phage Clone C | 8.66E-09 |
| Phage Clone D | 7.40E-08 |
| Phage Clone E | 1.70E-08 |
| Phage Clone F | 1.47E-08 |
| Phage Clone G | 2.84E-08 |
| Phage Clone 1A7 (XENP28428) | 1.45E-08 |

| | sequence | SEQ ID NO: |
|---|---|---|
| Variable heavy (vh) domain | QVQLVQSGAEVKKPGASVKVSCKASGYIFTNYYMHWVRQAPGQGLEWMGIISPSAGTTSYAQKFQGRVTMTRDTSTSTVYMELSSLRSEDTAVYYCARGGGSSPRLDYWGQGTLVTVSS | SEQ ID NO:928 |
| vhCDR1 | NYYMH | SEQ ID NO:929 |
| vhCDR2 | IISPSAGTTSYAQKFQG | SEQ ID NO:930 |
| vhCDR3 | GGGSSPRLDY | SEQ ID NO:931 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK | SEQ ID NO:932 |
| vlCDR1 | RASQSISSYLN | SEQ ID NO:933 |
| vlCDR2 | AASSLQS | SEQ ID NO:934 |
| vlCDR3 | QQSYSTPYT | SEQ ID NO:935 |

>XENP32637 2E4A3.189[B7H3]_H1L1_IgG1_PVA_/S267K

Heavy Chain SEQ ID NO:936

QVQLVQSGAEVKKPGASVKVSCKASGYIFTNYYMHWVRQAPGQGLEWMGIISPSAGTTSYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREEMTKNQVSLTCLVKGFYPSDIAVEWES
NGQPENNYKTTPPVLDSDGSFFLYSKLTVDKSRWQQGNVFSCSVMHEALHNHYTQKSLSLSPGK

Light Chain SEQ ID NO:937

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 27

| | sequence | SEQ ID NO: |
|---|---|---|
| Variable heavy (vh) domain 2E4A3.189_H1.3 | QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSS | SEQ ID NO:938 |
| vhCDR1 | NHYMH | SEQ ID NO:939 |
| vhCDR2 | IISPSAGSTDYAQKFQG | SEQ ID NO:940 |
| vhCDR3 | GGGSSPRLDY | SEQ ID NO:941 |

| | sequence | SEQ ID NO: |
|---|---|---|
| Variable heavy (vh) domain 2E4A3.189_H1.22 | QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSS | SEQ ID NO:942 |
| vhCDR1 | NNYMH | SEQ ID NO:943 |
| vhCDR2 | IISPSVGRTAYAQKFQG | SEQ ID NO:944 |
| vhCDR3 | GGGSSPRLDY | SEQ ID NO:945 |

| | sequence | SEQ ID NO: |
|---|---|---|
| Variable heavy (vh) domain | EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSS | SEQ ID NO:946 |
| vhCDR1 | NYYMA | SEQ ID NO:947 |
| vhCDR2 | SISTGGGSTYYRDSVKG | SEQ ID NO:948 |
| vhCDR3 | DLSAIAATPFAY | SEQ ID NO:949 |
| Variable light (vl) domain | DIQMTQSPSSLSASVGDRVTITCRASQNIYTSLAWYQQKPGKAPKLLIYNAHSLQTGIPSRFSGSGSGADFTLTISSLQPEDFATYFCQQYYSGLTFGSGTKLEIK | SEQ ID NO:950 |
| vlCDR1 | RASQNIYTSLA | SEQ ID NO:951 |
| vlCDR2 | NAHSLQT | SEQ ID NO:952 |
| vlCDR3 | QQYYSGLT | SEQ ID NO:953 |

>XENP33383 6A1[B7H3]_H1L1_IgG1_PVA_/S267K

Heavy Chain SEQ ID NO:954
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

Light Chain SEQ ID NO:955
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

| | sequence | SEQ ID NO: |
|---|---|---|
| Variable heavy (vh) domain | QVQLVQSGAEVKKPGASVKVSCKVSGFSLTSYHVSWVRQAPGQGLEWMGAISSGGSSYYNSKFQGRVTMTRDTSTSTVYMELSSLRSEDTAVYFCTGDLGAAISWFAYWGQGTLVTVSS | SEQ ID NO:956 |
| vhCDR1 | GFSLTSYHVS | SEQ ID NO:957 |
| vhCDR2 | AISSGGSSYYNSKFQG | SEQ ID NO:958 |
| vhCDR3 | DLGAAISWFAY | SEQ ID NO:959 |
| Variable light (vl) domain | DIQMTQSPSSLSASVGDRVTITCRTSQSIYKSLAWYQQKPGKAPKLLIYNAHSLQTGIPSRFSGSGSGTDFTLTISSLQPEDFATYFCQQYYSGLTFGSGTKLEIK | SEQ ID NO:960 |
| vlCDR1 | RTSQSIYKSLA | SEQ ID NO:961 |
| vlCDR2 | NAHSLQT | SEQ ID NO:962 |
| vlCDR3 | QQYYSGLT | SEQ ID NO:963 |

| | sequence | SEQ ID NO: |
|---|---|---|
| Variable heavy (vh) domain | EVQLVESGGGLVKPGGSLRLSCAASGFSFSVGYYMCWVRQAPGKGLEWVSCIYVGSGSSGSTYYASVKGRFTISSDTAKTSVYLQMNSLRAEDTAVYFCARTAGSDWRLDLWGQGTLVTVSS | SEQ ID NO:964 |
| vhCDR1 | VGYYMC | SEQ ID NO:965 |
| vhCDR2 | CIYVGSGSSGSTYYASVKG | SEQ ID NO:966 |
| vhCDR3 | TAGSDWRLDL | SEQ ID NO:967 |
| Variable light (vl) domain | DIVMTQSPSSLSASVGDRVTITCRASQSIANELSWYQQKPGKPPKLLIYRASTLTSGVPSRFKGSGSGTDFTLTISSLQPEDFATYYCQSTYNGRAIGFGGGTKVEIK | SEQ ID NO:968 |
| vlCDR1 | RASQSIANELS | SEQ ID NO:969 |
| vlCDR2 | RASTLTS | SEQ ID NO:970 |
| vlCDR3 | QSTYNGRAIG | SEQ ID NO:971 |

| | sequence | SEQ ID NO: |
|---|---|---|
| Variable heavy (vh) domain | EVQLLESGGGLVQPGGSLRLSCAVSGFSLSSYGVIWVRQAPGKGLEYVSWVSSGGSTNYASSVKGRFTISRDTSKNTVYLQMNSLRAEDTAVYFCARGATNSGTDIWGPGTLVTVSS | SEQ ID NO:972 |
| vhCDR1 | SYGVI | SEQ ID NO:973 |
| vhCDR2 | WVSSGGSTNYASSVKG | SEQ ID NO:974 |
| vhCDR3 | GATNSGTDI | SEQ ID NO:975 |
| Variable light (vl) domain | DIVMTQSPSSLSASVGDRVTITCRASQSINSWLSWYQQKPGKPPKLLIYGASNLASGVPSRFKGSGSGTDFTLTISSLQPEDFATYYCQNNYGIIAAGATFGGGTKVEIK | SEQ ID NO:976 |
| vlCDR1 | RASQSINSWLS | SEQ ID NO:977 |
| vlCDR2 | GASNLAS | SEQ ID NO:978 |
| vlCDR3 | QNNYGIIAAGAT | SEQ ID NO:979 |

Figure 32

| B7H3 Binding Domain | $K_D$ for human B7H3 (V1C1-V2C2) (nM) | $K_D$ for cynomolgus B7H3 (nM) |
|---|---|---|
| 2E4A3_H1.22_1A7_L1 | 7.6 | 4.3 |
| 2E4A3_H1.3_1A7_L1 | 12 | 7.0 |
| 2E4A3_H1.22_L1 | 6.1 | 5.3 |
| 6A1_H1L1 | 8.1 | 4.2 |
| 4F12_H2_L1.1 | <0.1 | <0.1 |
| 38E2_H2_L1.1 | 0.5 | 1.4 |
| 3C4_H1_L1.1 | 29.7 | 27.2 |

Figure 33A
anti-Antigen 1 Fab
anti-Antigen 2 scFv
1 + 1 Fab-scFv-Fc
Figure 33B
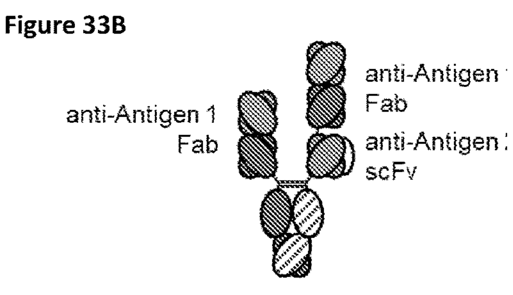
2 + 1 $Fab_2$-scFv-Fc
Figure 33C
anti-Antigen 1 Fab
anti-Antigen 2 Fab
1 + 1 Common Light Chain
Figure 33D
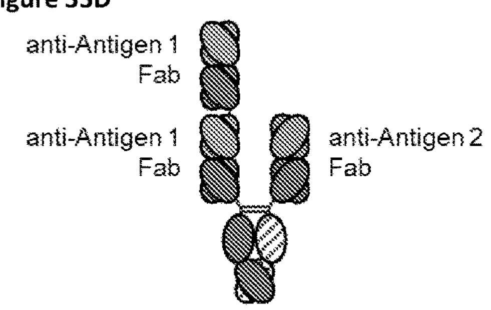
2 + 1 Common Light Chain
Figure 33E
anti-Antigen 1 Fab
anti-Antigen 1 Fab
anti-Antigen 2 scFv
2+1 mAb-scFv Figure 34A
anti-TAA Fab
anti-CD28 scFv
1 + 1 Fab-scFv-Fc
Figure 34B
anti-TAA Fab
anti-TAA Fab
anti-CD28 scFv
2 + 1 $Fab_2$-scFv-Fc
Figure 34C
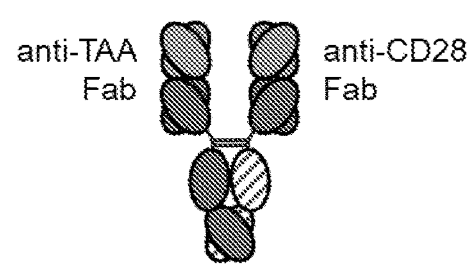
1 + 1 Common Light Chain
Figure 34D
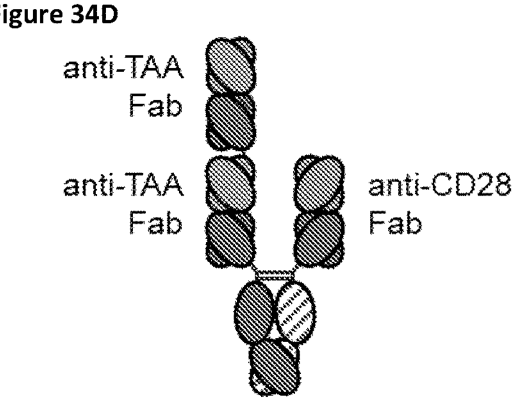
2 + 1 Common Light Chain
Figure 34E
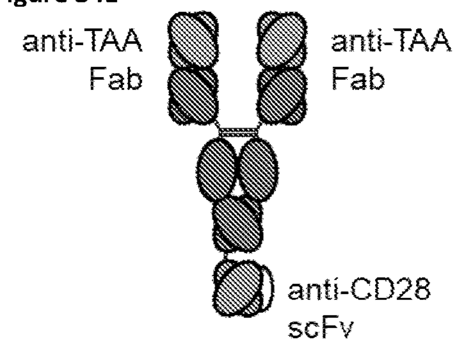
2+1 mAb-scFv

Figure 35A

>XENP34730 2E4A3.189[B7H3]_H1.22_L1_Fab-1A7[CD28]_H1.14_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 2E4A3.189[B7H3]_H1.22_Fab_IgG1_pI(-)_Isosteric_A_/PVA_/S267K/L368D/K370S SEQ ID NO:980
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - 1A7[CD28]_H1.14_L1_scFv(GKPGS)4_Fc(216)_IgG1_C220S/PVA_/S267K/S364K/E357Q SEQ ID NO:981
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/GKPGSGKPGSGKPGSGKPGS/DIQMTQSPSSL
SASVGDRVTITCRASQSISSYLNWYQQKPGKAPKLLIYAASSLQSGVPSRFSGSGSGTDFTLTISSLQPEDFATYYC
QQSYSTPFTFGQGTKLEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - 2E4A3.189[B7H3]_L1 Light Chain SEQ ID NO:982
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP34732 6A1[B7H3]_H1L1_Fab-1A7[CD28]_H1.14_L1_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 - 6A1[B7H3]_H1L1_Fab-IgG1_pI(-)_Isosteric_A_/PVA_/S267K/L368D/K370S/M428L/N434S SEQ ID NO:983
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

Chain 2 - 1A7[CD28]_H1.14_L1_scFv(GKPGS)4-Fc(216)_IgG1_C220S/PVA_/S267K/S364K/E357Q/M428L/N434S SEQ ID NO:984
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/GKPGSGKPGSGKPGSGKPGS/DIQMTQSPSSL
SASVGDRVTITCRASQSISSYLNWYQQKPGKAPKLLIYAASSLQSGVPSRFSGSGSGTDFTLTISSLQPEDFATYYC
QQSYSTPFTFGQGTKLEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
LHEALHSHYTQKSLSLSPGK

Chain 3 - 6A1[B7H3]_L1 SEQ ID NO:985
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 35B

>XENP35151 4F12[B7H3]_H2_L1.1_Fab-1A7[CD28]_H1.14_L1_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 - 4F12[B7H3]_H2_L1.1_Fab-IgG1_pI(-)_Isosteric_A_/PVA_/S267K/L368D/K370S/M428L/N434S
SEQ ID NO:986
EVQLVESGGGLVKPGGSLRLSCAASGFSFSVGYYMCWVRQAPGKGLEWVSCIYVGSGSSGSTYYASVKGRFTISSDT
AKTSVYLQMNSLRAEDTAVYFCARTAGSDWRLDLWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSDTKVDKKVEPKSCDKTHT
CPPCPAPPVAGPSVFLFPPKPKDTLMISRTPEVTCVVVDVKHEDPEVKFNWYVDGVEVHNAKTKPREEEYNSTYRVV
SVLTVLHQDWLNGKEYKCKVSNKALPAPIEKTISKAKGQPREPQVYTLPPSREEMTKNQVSLTCDVSGFYPSDIAVE
WESDGQPENNYKTTPPVLDSDGSFFLYSKLTVDKSRWEQGDVFSCSVLHEALHSHYTQKSLSLSPGK

Chain 2 - 1A7[CD28]_H1.14_L1_scFv(GKPGS)4-Fc(216)_IgG1_C220S/PVA_/S267K/S364K/E357Q/M428L/N434S
SEQ ID NO:987
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/GKPGSGKPGSGKPGSGKPGS/DIQMTQSPSSL
SASVGDRVTITCRASQSISSYLNWYQQKPGKAPKLLIYAASSLQSGVPSRFSGSGSGTDFTLTISSLQPEDFATYYC
QQSYSTPFTFGQGTKLEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
LHEALHSHYTQKSLSLSPGK

Chain 3 - 4F12[B7H3]_L1.1 SEQ ID NO:988
DIVMTQSPSSLSASVGDRVTITCRASQSIANELSWYQQKPGKPPKLLIYEASTLTSGVPSRFKGSGSGTDFTLTISS
LQPEDFATYYCQSTYNGRAIGFGGGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP35153 38E2[B7H3]_H2_L1.1_Fab-1A7[CD28]_H1.14_L1_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 - 38E2[B7H3]_H2_L1.1_Fab-IgG1_pI(-)_Isosteric_A_/PVA_/S267K/L368D/K370S/M428L/N434S
SEQ ID NO:989
EVQLLESGGGLVQPGGSLRLSCAVSGFSLSSYGVIWVRQAPGKGLEYVSWVSSGGSTNYASSVKGRFTISRDTSKNT
VYLQMNSLRAEDTAVYFCARGATNSGTDIWGPGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK

Chain 2 - 1A7[CD28]_H1.14_L1_scFv(GKPGS)4-Fc(216)_IgG1_C220S/PVA_/S267K/S364K/E357Q/M428L/N434S
SEQ ID NO:990
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/GKPGSGKPGSGKPGSGKPGS/DIQMTQSPSSL
SASVGDRVTITCRASQSISSYLNWYQQKPGKAPKLLIYAASSLQSGVPSRFSGSGSGTDFTLTISSLQPEDFATYYC
QQSYSTPFTFGQGTKLEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
LHEALHSHYTQKSLSLSPGK

Chain 3 - 38E2[B7H3]_L1.1 SEQ ID NO:991
DIVMTQSPSSLSASVGDRVTITCRASQSINSWLSWYQQKPGKPPKLLIYGASNLASGVPSRFKGSGSGTDFTLTISS
LQPEDFATYYCQNNYGIIAAGATFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

Figure 36A

>XENP34389 6A1[B7H3]_H1L1_Fab-6A1[B7H3]_H1L1_Fab_(G4S)2_1A7[CD28]_H1.14_L1_scFv(GKPGS)4_(G4S)2-IgG1_pI(-)_Isosteric_A_/PVA_/S267K/L368D/K370S-Fc(222)_IgG1_PVA_/S267K/S364K/E357Q

Chain 1 - 6A1[B7H3]_H1_Fab_IgG1_pI(-)_Isosteric_A_/PVA_/S267K/L368D/K370S SEQ ID NO:992
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 – 6A1[B7H3]_H1_Fab_(G4S)2_1A7[CD28]_H1.14_L1_scFv(GKPGS)4_(G4S)2_Fc(222)_IgG1_PVA_/S267K/S364K/E357Q SEQ ID NO:993
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/GGGGS
GGGGS/EVQLLESGGGLVQPGGSLRLSCAASGFTFSSYYMSWVRQAPGKGLEWVSTISESGDSTYYADSVKGRFTIS
RDNSKNTLYLQMNSLRAEDTAVYYCAKSGPGLPQVGFDYWGQGTLVTVSS/GKPGSGKPGSGKPGSGKPGS/DIQMT
QSPSSLSASVGDRVTITCRASQSISSYLNWYQQKPGKAPKLLIYAASSLQSGVPSRFSGSGSGTDFTLTISSLQPED
FATYYCQQSYSTPFTFGQGTKLEIK/GGGGSGGGGSKTHTCPPCP/APPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK

Chain 3 - 6A1[B7H3]_L1 Light Chain SEQ ID NO:994
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 36B

>XENP34395 6A1[B7H3]_H1L1_Fab-6A1[B7H3]_H1L1_Fab_(G4S)2_1A7[CD28]_H1.14_L1_scFv(GKPGS)4_(G4S)2-IgG1_pI(-)_Isosteric_A_/PVA_/S267K/L368D/K370S/M428L/N434S-Fc(222)_IgG1_PVA_/S267K/S364K/E357Q/M428L/N434S

Chain 1 - 6A1[B7H3]_H1_Fab-IgG1_pI(-)_Isosteric_A_/PVA_/S267K/L368D/K370S/M428L/N434S SEQ ID NO:995
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

Chain 2 - 6A1[B7H3]_H1_Fab_(G4S)2_1A7[CD28]_H1.14_L1_scFv(GKPGS)4_(G4S)2-Fc(222)_IgG1_PVA_/S267K/S364K/E357Q/M428L/N434S SEQ ID NO:996
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKV/EPKSCGGGGS
GGGGS/EVQLLESGGGLVQPGGSLRLSCAASGFTFSSYYMSWVRQAPGKGLEWVSTISESGDSTYYADSVKGRFTIS
RDNSKNTLYLQMNSLRAEDTAVYYCAKSGPGLRQVGFDYWGQGTLVTVSS/GKPGSGKPGSGKPGSGKPGS/DIQMT
QSPSSLSASVGDRVTITCRASQSISSYLNWYQQKPGKAPKLLIYAASSLQSGVPSRFSGSGSGTDFTLTISSLQPED
FATYYCQQSYSTPFTFGQGTKLEIK/GGGGSGGGGSKTHTCPPCP/APPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVLHEALHSHYTQKSLSLSPGK

Figure 36C

Chain 3 - 6A1[B7H3]_L1 SEQ ID NO:997
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP34728 6A1[B7H3]_H1L1_Fab-1A7[CD28]_H1.14_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 6A1[B7H3]_H1_Fab_IgG1_pI(-)_Isosteric_A_/PVA_/S267K/L368D/K370S SEQ ID NO:998
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - 1A7[CD28]_H1.14_L1_scFv(GKPGS)4_Fc(216)_IgG1_C220S/PVA_/S267K/S364K/E357Q SEQ ID NO:999
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSSGKPGSGKPGSGKPGSGKPGSDIQMTQSPSSLSA
SVGDRVTITCRASQSISSYLNWYQQKPGKAPKLLIYAASSLQSGVPSRFSGSGSGTDFTLTISSLQPEDFATYYCQQ
SYSTPFTFGQGTKLEIKEPKSSDKTHTCPPCPAPPVAGPSVFLFPPKPKDTLMISRTPEVTCVVVDVKHEDPEVKFN
WYVDGVEVHNAKTKPREEQYNSTYRVVSVLTVLHQDWLNGKEYKCKVSNKALPAPIEKTISKAKGQPREPQVYTLPP
SREQMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Chain 3 - 6A1[B7H3]_L1 Light Chain SEQ ID NO:1000
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 37

>XENP34717 1A7[CD28]_H1.14_L1_Fab-2E4A3.189[B7H3]_H1.22_1A7[CD28]_L1_Fab-IgG1_pI(-)_Isosteric_A_PVA_/S267K/L368D/K370S-IgG1_PVA_/S267K/S364K/E357Q

Chain 1 - 1A7[CD28]_H1.14_Fab_IgG1_pI(-)_Isosteric_A_PVA_/S267K/L368D/K370S SEQ ID NO:1001
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - 2E4A3.189[B7H3]_H1.22_Fab_IgG1_PVA_/S267K/S364K/E357Q SEQ ID NO:1002
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVMHEALHNHYTQKSLSLSPGK

Chain 3 - 1A7[CD28]_L1 Light Chain SEQ ID NO:1003
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 38A

>XENP34336 1A7[CD28]_H1.14_L1_Fab-2E4A3.189[B7H3]_H1.3_1A7[CD28]_L1_Fab_(GKPGS)2_2E4A3.189[B7H3]_H1.3_1A7[CD28]_L1_Fab-IgG1_pI(-)_Isosteric_A_PVA_/S267K/L368D/K370S-IgG1_PVA_/S267K/S364K/E357Q

Chain 1 -1A7[CD28]_H1.14_L1_Fab-IgG1_pI(-)_Isosteric_A_PVA_/S267K/L368D/K370S SEQ ID NO:1004
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 -2E4A3.189[B7H3]_H1.3_1A7[CD28]_L1_Fab_(GKPGS)2_2E4A3.189[B7H3]_H1.3_1A7[CD28]_L1_Fab-IgG1_PVA_/S267K/S364K/E357Q SEQ ID NO:1005
QVQLVQSGAEVKKPGASVKVSCKASGYIFTNHYMHWVRQAPGQGLEWMGIISPSAGSTDYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNHYMHWVRQAPGQGLEWMGIISPSAGSTDYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVMHEALHNHYTQKSLSLSPGK

Chain 3 -1A7[CD28]_L1 SEQ ID NO:1006
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 38B

>XENP34339 1A7[CD28]_H1.14_L1_Fab-2E4A3.189[B7H3]_H1.22_1A7[CD28]_L1_Fab_(GKPGS)2_2E4A3.189[B7H3]_H1.22_1A7[CD28]_L1_Fab-IgG1_pI(-)_Isosteric_A_PVA_/S267K/L368D/K370S-IgG1_PVA_/S267K/S364K/E357Q

Chain 1 - 1A7[CD28]_H1.14_Fab_IgG1_pI(-)_Isosteric_A_PVA_/S267K/L368D/K370S SEQ ID NO:1007
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLPQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - 2E4A3.189[B7H3]_H1.22_Fab_(GKPGS)2_2E4A3.189[B7H3]_H1.22_Fab_IgG1_PVA_/S267K/S364K/E357Q SEQ ID NO:1008
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNNYMHWVRQAPGQGLEWMGIISPSVGRTAYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVMHEALHNHYTQKSLSLSPGK

Chain 3 - 1A7[CD28]_L1 Light Chain SEQ ID NO:1009
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 38C

>XENP34398 1A7[CD28]_H1.14_L1_Fab-2E4A3.189[B7H3]_H1.22_1A7_L1_Fab_(GKPGS)2_2E4A3.189[B7H3]_H1.22_1A7_L1_Fab-IgG1_pI(-)_Isosteric_A_PVA_/S267K/L368D/K370S/M428L/N434S-IgG1_PVA_/S267K/S364K/E357Q/M428L/N434S

Chain 1 -1A7[CD28]_H1.14_L1_Fab-IgG1_pI(-)_Isosteric_A_PVA_/S267K/L368D/K370S/M428L/N434S
SEQ ID NO:1010
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

Chain 2 -2E4A3.189[B7H3]_H1.22_1A7_L1_Fab_(GKPGS)2_2E4A3.189[B7H3]_H1.22_1A7_L1_Fab-IgG1_PVA_/S267K/S364K/E357Q/M428L/N434S SEQ ID NO:1011
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNNYMHWVRQAPGQGLEWMGIISPSVGRTAYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVLHEALHSHYTQKSLSLSPGK

Chain 3 -1A7[CD28]_L1 SEQ ID NO:1012
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 38D

>XENP35611 1A7[CD28]_H1L1_Fab-2E4A3.189[B7H3]_H1.22_1A7[CD28]_L1_Fab_(GKPGS)2_2E4A3.189[B7H3]_H1.22_1A7[CD28]_L1_Fab-IgG1_pI(-)_Isosteric_A_PVA_/S267K/L368D/K370S-IgG1_PVA_/S267K/S364K/E357Q

Chain 1 -1A7[CD28]_H1L1_Fab-IgG1_pI(-)_Isosteric_A_PVA_/S267K/L368D/K370S SEQ ID NO:1013

EVQLLESGGGLVQPGGSLRLSCAASGFTFSSYAMSWVRQAPGKGLEWVSTISGSGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 -2E4A3.189[B7H3]_H1.22_1A7[CD28]_L1_Fab_(GKPGS)2_2E4A3.189[B7H3]_H1.22_1A7[CD28]_L1_Fab-IgG1_PVA_/S267K/S364K/E357Q SEQ ID NO:1014

QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNNYMHWVRQAPGQGLEWMGIISPSVGRTAYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVMHEALHNHYTQKSLSLSPGK

Chain 3 -1A7[CD28]_L1 SEQ ID NO:1015

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP35612 1A7[CD28]_H1.1_L1_Fab-2E4A3.189[B7H3]_H1.22_1A7[CD28]_L1_Fab_(GKPGS)2_2E4A3.189[B7H3]_H1.22_1A7[CD28]_L1_Fab-IgG1_pI(-)_Isosteric_A_PVA_/S267K/L368D/K370S-IgG1_PVA_/S267K/S364K/E357Q

Chain 1 -1A7[CD28]_H1.1_L1_Fab-IgG1_pI(-)_Isosteric_A_PVA_/S267K/L368D/K370S SEQ ID NO:1016

EVQLLESGGGLVQPGGSLRLSCAASGFTFSSYYMSWVRQAPGKGLEWVSTISGSGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 -2E4A3.189[B7H3]_H1.22_1A7[CD28]_L1_Fab_(GKPGS)2_2E4A3.189[B7H3]_H1.22_1A7[CD28]_L1_Fab-IgG1_PVA_/S267K/S364K/E357Q SEQ ID NO:1017

QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNNYMHWVRQAPGQGLEWMGIISPSVGRTAYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVMHEALHNHYTQKSLSLSPGK

Chain 3 -1A7[CD28]_L1 SEQ ID NO:1018

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 38E

>XENP37808 1A7[CD28]_H1.1_L1_Fab-2E4A3.189[B7H3]_H1.22_1A7[CD28]_L1_Fab_(GKPGS)2_2E4A3.189[B7H3]_H1.22_1A7[CD28]_L1_Fab-IgG1_pI(-)_Isosteric_A_PVA_/S267K/L368D/K370S/M428L/N434S-IgG1_PVA_/S267K/S364K/E357Q/M428L/N434S

Chain 1 -1A7[CD28]_H1.1_L1_Fab-IgG1_pI(-)_Isosteric_A_PVA_/S267K/L368D/K370S/M428L/N434S
SEQ ID NO:1019
EVQLLESGGGLVQPGGSLRLSCAASGFTFSSYYMSWVRQAPGKGLEWVSTISGSGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

Chain 2 -2E4A3.189[B7H3]_H1.22_1A7[CD28]_L1_Fab_(GKPGS)2_2E4A3.189[B7H3]_H1.22_1A7[CD28]_L1_Fab-IgG1_PVA_/S267K/S364K/E357Q/M428L/N434S SEQ ID NO:1020
QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNNYMHWVRQAPGQGLEWMGIISPSVGRTAYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVLHEALHSHYTQKSLSLSPGK

Chain 3 -1A7[CD28]_L1 SEQ ID NO:1021
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP37810 1A7[CD28]_H1.14_L1_Fab-2E4A3.189[B7H3]_H1.3_1A7[CD28]_L1_Fab_(GKPGS)2_2E4A3.189[B7H3]_H1.3_1A7[CD28]_L1_Fab-IgG1_pI(-)_Isosteric_A_PVA_/S267K/L368D/K370S/M428L/N434S-IgG1_PVA_/S267K/S364K/E357Q/M428L/N434S

Chain 1 -1A7[CD28]_H1.14_L1_Fab-IgG1_pI(-)_Isosteric_A_PVA_/S267K/L368D/K370S/M428L/N434S
SEQ ID NO:1022
EVQLLESGGGLVQPGGSLRLSCAASGFTFSSYYMSWVRQAPGKGLEWVSTISESGDSTYYADSVKGRFTISRDNSKN
TLYLQMNSLRAEDTAVYYCAKSGPGLRQVGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

Chain 2 -2E4A3.189[B7H3]_H1.3_1A7[CD28]_L1_Fab_(GKPGS)2_2E4A3.189[B7H3]_H1.3_1A7[CD28]_L1_Fab-IgG1_PVA_/S267K/S364K/E357Q/M428L/N434S SEQ ID NO:1023
QVQLVQSGAEVKKPGASVKVSCKASGYIFTNHYMHWVRQAPGQGLEWMGIISPSAGSTDYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKV/EPKSCGKPGSGK
PGS/QVQLVQSGAEVKKPGASVKVSCKASGYIFTNHYMHWVRQAPGQGLEWMGIISPSAGSTDYAQKFQGRVTMTRD
TSTSTVYMELSSLRSEDTAVYYCARGGGSSPRLDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVLHEALHSHYTQKSLSLSPGK

Chain 3 -1A7[CD28]_L1 SEQ ID NO:1024
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPFTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 39A

>XENP36781 6A1[B7H3]_H1L1_Fab-6A1[B7H3]_H1L1_Fab-IgG1_pI(-)_Isosteric_A_/PVA_/S267K/L368D/K370S/M428L/N434S-IgG1_PVA_/S267K/S364K/E357Q/M428L/N434S/K447del_(G4S)3_1A7[CD28]_H1.14_L1_scFv(GKPGS)4

Chain 1 - 6A1[B7H3]_H1L1_Fab-IgG1_pI(-)_Isosteric_A_/PVA_/S267K/L368D/K370S/M428L/N434S
SEQ ID NO:1025
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

Chain 2 - 6A1[B7H3]_H1L1_Fab-IgG1_PVA_/S267K/S364K/E357Q/M428L/N434S/K447del_(G4S)3_1A7[CD28]_H1.14_L1_scFv(GKPGS)4
SEQ ID NO:1026
EVQLLESGGGLVQPGGSLRLSCAASGFTFSNYYMAWVRQAPGKGLEWVSSISTGGGSTYYRDSVKGRFTISRDNSKS
TLYLQMNSLRAEDTAVYYCTTDLSAIAATPFAYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVLHEALHSHYTQKSLSLSP/GGGGGSGGGGSG
GGGS/EVQLLESGGGLVQPGGSLRLSCAASGFTFSSYYMSWVRQAPGKGLEWVSTISESGDSTYYADSVKGRFTISR
DNSKNTLYLQMNSLRAEDTAVYYCAKSGPGLRQVGFDYWGQGTLVTVSS/GKPGSGKPGSGKPGSGKPGS/DIQMTQ
SPSSLSASVGDRVTITCRASQSISSYLNWYQQKPGKAPKLLIYAASSLQSGVPSRFSGSGSGTDFTLTISSLQPEDF
ATYYCQQSYSTPFTFGQGTKLEIK

Chain 3 - 6A1[B7H3]_L1 SEQ ID NO:1027
DIQMTQSPSSLSASVGDRVTITCRASQNIYTSLAWYQQKPGKAPKLLIYNAHSLQTGIPSRFSGSGSGADFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 39B

>XENP37805 2E4A3.189[B7H3]_H1L1_Fab-2E4A3.189[B7H3]_H1L1_Fab-IgG1_pI(-)_Isosteric_A_/PVA_/S267K/L368D/K370S/M428L/N434S-IgG1_PVA_/S267K/S364K/E357Q/M428L/N434S/K447del_(G4S)3_1A7[CD28]_H1.14_L1_scFv(GKPGS)4

Chain 1 - 2E4A3.189[B7H3]_H1L1_Fab-IgG1_pI(-)_Isosteric_A_/PVA_/S267K/L368D/K370S/M428L/N434S SEQ ID NO:1028

QVQLVQSGAEVKKPGASVKVSCKASGYIFTNYYMHWVRQAPGQGLEWMGIISPSAGTTSYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVLHEALHSHYTQKSLSLSPGK

Chain 2 - 2E4A3.189[B7H3]_H1L1_Fab-IgG1_PVA_/S267K/S364K/E357Q/M428L/N434S/K447del_(G4S)3_1A7[CD28]_H1.14_L1_scFv(GKPGS)4 SEQ ID NO:1029

QVQLVQSGAEVKKPGASVKVSCKASGYIFTNYYMHWVRQAPGQGLEWMGIISPSAGTTSYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVLHEALHSHYTQKSLSLSP/GGGGGSGGGGSGGG
GS/EVQLLESGGGLVQPGGSLRLSCAASGFTFSSYYMSWVRQAPGKGLEWVSTISESGDSTYYADSVKGRFTISRDN
SKNTLYLQMNSLRAEDTAVYYCAKSGPGLRQVGFDYWGQGTLVTVSS/GKPGSGKPGSGKPGSGKPGS/DIQMTQSP
SSLSASVGDRVTITCRASQSISSYLNWYQQKPGKAPKLLIYAASSLQSGVPSRFSGSGSGTDFTLTISSLQPEDFAT
YYCQQSYSTPFTFGQGTKLEIK

Chain 3 - 2E4A3.189[B7H3]_L1 SEQ ID NO:1030

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 39C

>XENP37806 2E4A3.189[B7H3]_H1.3_L1_Fab-2E4A3.189[B7H3]_H1.3_L1_Fab-IgG1_pI(-)_Isosteric_A_/PVA_/S267K/L368D/K370S/M428L/N434S-IgG1_PVA_/S267K/S364K/E357Q/M428L/N434S/K447del_(G4S)3_1A7[CD28]_H1.14_L1_scFv(GKPGS)4

Chain 1 - 2E4A3.189[B7H3]_H1.3_L1_Fab-IgG1_pI(-)_Isosteric_A_/PVA_/S267K/L368D/K370S/M428L/N434S SEQ ID NO:1031

QVQLVQSGAEVKKPGASVKVSCKASGYIFTNHYMHWVRQAPGQGLEWMGIISPSAGSTDYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVLHEALHSHYTQKSLSLSPGK

Chain 2 - 2E4A3.189[B7H3]_H1.3_L1_Fab-IgG1_PVA_/S267K/S364K/E357Q/M428L/N434S/K447del_(G4S)3_1A7[CD28]_H1.14_L1_scFv(GKPGS)4 SEQ ID NO:1032

QVQLVQSGAEVKKPGASVKVSCKASGYIFTNHYMHWVRQAPGQGLEWMGIISPSAGSTDYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVLHEALHSHYTQKSLSLSP/GGGGGSGGGGSGGG
GS/EVQLLESGGGLVQPGGSLRLSCAASGFTFSSYYMSWVRQAPGKGLEWVSTISESGDSTYYADSVKGRFTISRDN
SKNTLYLQMNSLRAEDTAVYYCAKSGPGLRQVGFDYWGQGTLVTVSS/GKPGSGKPGSGKPGSGKPGS/DIQMTQSP
SSLSASVGDRVTITCRASQSISSYLNWYQQKPGKAPKLLIYAASSLQSGVPSRFSGSGSGTDFTLTISSLQPEDFAT
YYCQQSYSTPFTFGQGTKLEIK

Chain 3 - 2E4A3.189[B7H3]_L1 SEQ ID NO:1033

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 39D

>XENP37807 2E4A3.189[B7H3]_H1.22_L1_Fab-2E4A3.189[B7H3]_H1.22_L1_Fab-IgG1_pI(-)_Isosteric_A_/PVA_/S267K/L368D/K370S/M428L/N434S-IgG1_PVA_/S267K/S364K/E357Q/M428L/N434S/K447del_(G4S)3_1A7[CD28]_H1.14_L1_scFv(GKPGS)4

Chain 1 - 2E4A3.189[B7H3]_H1.22_L1_Fab-IgG1_pI(-)_Isosteric_A_/PVA_/S267K/L368D/K370S/M428L/N434S SEQ ID NO:1034

QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVLHEALHSHYTQKSLSLSPGK

Chain 2 - 2E4A3.189[B7H3]_H1.22_L1_Fab-IgG1_PVA_/S267K/S364K/E357Q/M428L/N434S/K447del_(G4S)3_1A7[CD28]_H1.14_L1_scFv(GKPGS)4 SEQ ID NO:1035

QVQLVQSGAEVKKPGASVKVSCKASGYIFTNNYMHWVRQAPGQGLEWMGIISPSVGRTAYAQKFQGRVTMTRDTSTS
TVYMELSSLRSEDTAVYYCARGGGSSPRLDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVLHEALHSHYTQKSLSLSP/GGGGGSGGGGSGGG
GS/EVQLLESGGGLVQPGGSLRLSCAASGFTFSSYYMSWVRQAPGKGLEWVSTISESGDSTYYADSVKGRFTISRDN
SKNTLYLQMNSLRAEDTAVYYCAKSGPGLRQVGFDYWGQGTLVTVSS/GKPGSGKPGSGKPGSGKPGS/DIQMTQSP
SSLSASVGDRVTITCRASQSISSYLNWYQQKPGKAPKLLIYAASSLQSGVPSRFSGSGSGTDFTLTISSLQPEDFAT
YYCQQSYSTPFTFGQGTKLEIK

Chain 3 - 2E4A3.189[B7H3]_L1 SEQ ID NO:1036

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 39E

>XENP37982 3C4[B7H3]_H1_L1.1_Fab-3C4[B7H3]_H1_L1.1_Fab-IgG1_pI(-)_Isosteric_A_/PVA_/S267K/L368D/K370S/M428L/N434S-IgG1_PVA_/S267K/S364K/E357Q/M428L/N434S/K447del_(G4S)3_1A7[CD28]_H1.14_L1_scFv(GKPGS)4

Chain 1 - 3C4[B7H3]_H1_L1.1_Fab-IgG1_pI(-)_Isosteric_A_/PVA_/S267K/L368D/K370S/M428L/N434S SEQ ID NO:1037

QVQLVQSGAEVKKPGASVKVSCKVSGFSLTSYHVSWVRQAPGQGLEWMGAISSGGSSYYNSKFQGRVTMTRDTSTST
VYMELSSLRSEDTAVYFCTGDLGAAISWFAYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVLHEALHSHYTQKSLSLSPGK

Chain 2 - 3C4[B7H3]_H1_L1.1_Fab-IgG1_PVA_/S267K/S364K/E357Q/M428L/N434S/K447del_(G4S)3_1A7[CD28]_H1.14_L1_scFv(GKPGS)4 SEQ ID NO:1038

QVQLVQSGAEVKKPGASVKVSCKVSGFSLTSYHVSWVRQAPGQGLEWMGAISSGGSSYYNSKFQGRVTMTRDTSTST
VYMELSSLRSEDTAVYFCTGDLGAAISWFAYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVLHEALHSHYTQKSLSLSP/GGGGGSGGGGSGGG
GS/EVQLLESGGGLVQPGGSLRLSCAASGFTFSSYYMSWVRQAPGKGLEWVSTISESGDSTYYADSVKGRFTISRDN
SKNTLYLQMNSLRAEDTAVYYCAKSGPGLRQVGFDYWGQGTLVTVSS/GKPGSGKPGSGKPGSGKPGS/DIQMTQSP
SSLSASVGDRVTITCRASQSISSYLNWYQQKPGKAPKLLIYAASSLQSGVPSRFSGSGSGTDFTLTISSLQPEDFAT
YYCQQSYSTPFTFGQGTKLEIK

Chain 3 - 3C4[B7H3]_L1.1 SEQ ID NO:1039

DIQMTQSPSSLSASVGDRVTITCRTSQSIYKSLAWYQQKPGKAPKLLIYNAHSLQTGIPSRFSGSGSGTDFTLTISS
LQPEDFATYFCQQYYSGLTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

XENP34717 B7H3 (2E4A3.189_H1.3) x CD28 (1A7) (1+1 CLC)

XENP34336 B7H3 (2E4A3.189_H1.3) x CD28 (1A7 440 nM) (2+1 CLC)

XENP34339 B7H3 (2E4A3.189_H1.22) x CD28 (1A7 77 nM) (2+1 CLC)

XENP35611 B7H3 (2E4A3.189_H1.22) x CD28 (1A7_H1L1 610 nM) (2+1 CLC)

XENP35612 B7H3 (2E4A3.189_H1.22) x CD28 (1A7_H1.1_L1 270 nM) (2+1 CLC)

XENP34398 [2+1 CLC] - 2E4A3.189[B7H3]_H1.22_1A7_L1 x 1A7[CD28]_H1.14_L1 + Xtend
XENP37808 [2+1 CLC] - 2E4A3.189[B7H3]_H1.22_1A7_L1 x 1A7[CD28]_H1.1_L1 + Xtend
XENP37810 [2+1 CLC] - 2E4A3.189[B7H3]_H1.3_1A7_L1 x 1A7[CD28]_H1.14_L1 + Xtend
XENP34732 [1+1 Fab-scFv-Fc] - 6A1[B7H3]_H1L1 x 1A7[CD28]_H1.14_L1 + Xtend
XENP35151 [1+1 Fab-scFv-Fc] - 4F12[B7H3]_H2_L1.1 x 1A7[CD28]_H1.14_L1 + Xtend
XENP35153 [1+1 Fab-scFv-Fc] - 38E2[B7H3]_H2_L1.1 x 1A7[CD28]_H1.14_L1 + Xtend
XENP37807 [2+1 mAb-scFv] - 2E4A3.189[B7H3]_H1.22_L1 x 1A7[CD28]_H1.14_L1 + Xtend
XENP37982 [2+1 mAb-scFv] - 3C4[B7H3]_H1_L1.1 x 1A7[CD28]_H1.14_L1 + Xtend XENP34398 [2+1 CLC] - 2E4A3.189[B7H3]_H1.22_1A7_L1 x 1A7[CD28]_H1.14_L1 + Xtend
XENP37808 [2+1 CLC] - 2E4A3.189[B7H3]_H1.22_1A7_L1 x 1A7[CD28]_H1.1_L1 + Xtend
XENP37810 [2+1 CLC] - 2E4A3.189[B7H3]_H1.3_1A7_L1 x 1A7[CD28]_H1.14_L1 + Xtend
XENP34732 [1+1 Fab-scFv-Fc] - 6A1[B7H3]_H1L1 x 1A7[CD28]_H1.14_L1 + Xtend
XENP35151 [1+1 Fab-scFv-Fc] - 4F12[B7H3]_H2_L1.1 x 1A7[CD28]_H1.14_L1 + Xtend
XENP35153 [1+1 Fab-scFv-Fc] - 38E2[B7H3]_H2_L1.1 x 1A7[CD28]_H1.14_L1 + Xtend
XENP37807 [2+1 mAb-scFv] - 2E4A3.189[B7H3]_H1.22_L1 x 1A7[CD28]_H1.14_L1 + Xtend
XENP37982 [2+1 mAb-scFv] - 3C4[B7H3]_H1_L1.1 x 1A7[CD28]_H1.14_L1 + Xtend

- XENP34398 [2+1 CLC] - 2E4A3.189[B7H3]_H1.22_1A7_L1 x 1A7[CD28]_H1.14_L1 + Xtend
- XENP37808 [2+1 CLC] - 2E4A3.189[B7H3]_H1.22_1A7_L1 x 1A7[CD28]_H1.1_L1 + Xtend
- XENP37810 [2+1 CLC] - 2E4A3.189[B7H3]_H1.3_1A7_L1 x 1A7[CD28]_H1.14_L1 + Xtend
- XENP34732 [1+1 Fab-scFv-Fc] - 6A1[B7H3]_H1L1 x 1A7[CD28]_H1.14_L1 + Xtend
- XENP35151 [1+1 Fab-scFv-Fc] - 4F12[B7H3]_H2_L1.1 x 1A7[CD28]_H1.14_L1 + Xtend
- XENP35153 [1+1 Fab-scFv-Fc] - 38E2[B7H3]_H2_L1.1 x 1A7[CD28]_H1.14_L1 + Xtend
- XENP37807 [2+1 mAb-scFv] - 2E4A3.189[B7H3]_H1.22_L1 x 1A7[CD28]_H1.14_L1 + Xtend
- XENP37982 [2+1 mAb-scFv] - 3C4[B7H3]_H1_L1.1 x 1A7[CD28]_H1.14_L1 + Xtend

Figure 44

| 1A7 VH | SEQ | SEQ ID | |
|---|---|---|---|
| HFR1 | EVQLLESGGGLVQPGGSLRLSCAASGF$X_1X_2X_3$ | 1184 | $X_1$ is selected from T,S,N; $X_2$ is selected from F, L; and $X_3$ is selected from S, E, R, K, G, T, A, N |
| HCDR1 | $X_1X_2X_3X_4X_5$ | 1185 | $X_1$ is selected from S, G, E, T, D, A, R, K; $X_2$ is selected from Y, N; $X_3$ is selected from A, Y, S; $X_4$ is selected from M, I; and $X_5$ is selected from S, T, N |
| HFR2 | WVRQAPGKGLEWV$X_1$ | 1186 | $X_1$ is selected from S, A |
| HCDR2 | $X_1$I$X_2X_3X_4X_5X_6X_7$TYYADSVKG | 1187 | $X_1$ is selected from T, S; $X_2$ is selected from S, D, E, Y, T; $X_3$ is selected from G, D, E, A, Y, S, N, T; $X_4$ is selected from S, D, N, G; $X_5$ is selected from D, T, Y, S, A; $X_6$ is selected from D, T, Y, S, A; and $X_7$ is selected from S, Y, A, T, D, N |
| HFR3 | RFTISRDNSKNTLYLQMNSLRAEDTAVYYCAK | 1188 | |
| HCDR3 | SGPGLRQVGFDY | 1189 | |
| HFR4 | WGQGTLVTVSS | 1190 | |
| **1A7 VL** | | | |
| LFR1 | DIQMTQSPSSLSASVGDRVTITC | 1191 | |
| LCDR1 | RASQSIS$X_1X_2$L$X_3$ | 1192 | $X_1$ is selected from S, A, D, G, H, K, N, Q, T, V, Y; $X_2$ is selected from Y, A, D, F, H, K, L, N, Q, S, W; and $X_3$ is selected from N, A, D, G, H, Q, S, T, Y |
| LFR2 | WYQQKPGKAPKLLIY | 1193 | |
| LCDR2 | $X_1$AS$X_2$L$X_3X_4$ | 1194 | $X_1$ is selected from A, D, G, K, L, Q, S, T, W, Y; $X_2$ is selected from S, A, D, K, N, Q, T, Y; $X_3$ is selected from Q, A, E, F, H, I, K, N, S, V, Y; and $X_4$ is selected from Q, A, E, F, H, I, K, N, S, V, Y |
| LFR3 | GVPSRFSGSGSGTDFTLTISSLQPEDFATYYC | 1195 | |
| LCDR3 | QQ$X_1X_2X_3X_4$P$X_5$T | 1196 | $X_1$ is selected from S, A, D, F, H, K, L, T, V, Y; $X_2$ is selected from Y, A, D, F, H, K, L, Q, V, W; $X_3$ is selected from S, A, D, G, H, K, N, Q, T, V, Y; $X_4$ is selected from T, A, D, F, I, K, L, Q, S, V, Y; and $X_5$ is selected from F, I, L, W |
| LFR4 | FGQGTKLEIK | 1197 | |

Figure 45A
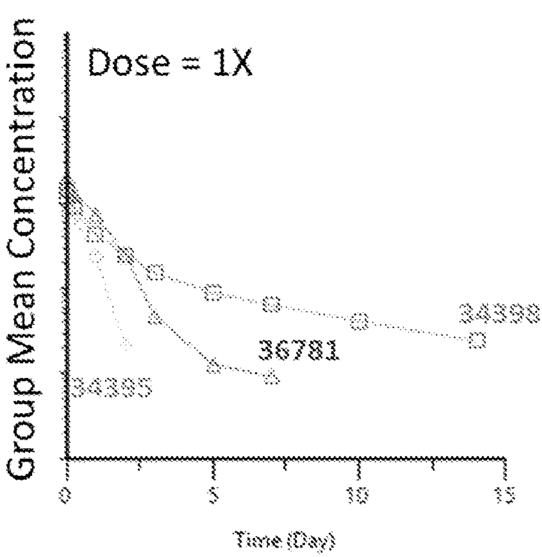
Figure 45B
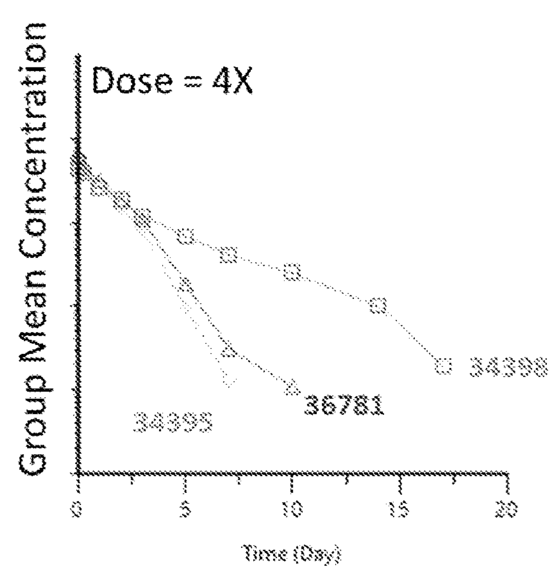
Figure 45C
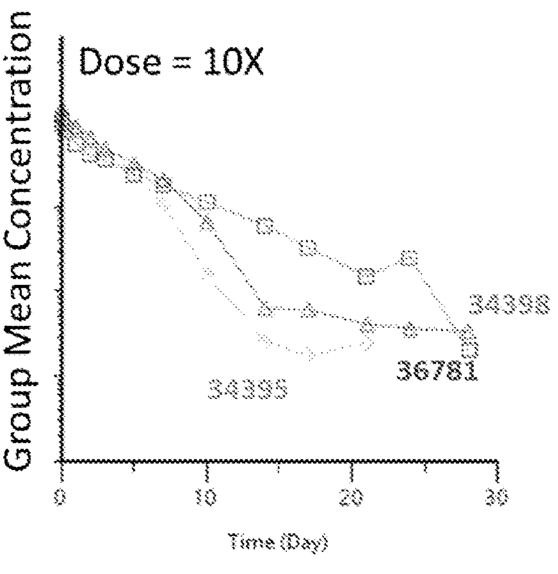
Figure 45D
XENP34398: 2 + 1 CLC
XENP36781: 2 + 1 mAb-scFv
XENP34395: 2 + 1 $Fab_2$-scFv-Fc XENP34398 [2+1 CLC] - 2E4A3.189[B7H3]_H1.22_1A7_L1 x 1A7[CD28]_H1.14_L1 + Xtend
Concentration
0
5
10
15
Time (days post dose)

XENP37808 [2+1 CLC] - 2E4A3.189[B7H3]_H1.22_1A7_L1 x 1A7[CD28]_H1.1_L1 + Xtend
Concentration
0
5
10
15
Time (days post dose)

XENP37810 [2+1 CLC] - 2E4A3.189[B7H3]_H1.3_1A7_L1 x 1A7[CD28]_H1.14_L1 + Xtend
Concentration
0
5
10
15
Time (days post dose)

XENP34732 [1+1 Fab-scFv-Fc] - 6A1[B7H3]_H1L1 x 1A7[CD28]_H1.14_L1 + Xtend
Concentration
0
5
10
15
Time (days post dose)

XENP35151 [1+1 Fab-scFv-Fc] - 4F12[B7H3]_H2_L1.1 x 1A7[CD28]_H1.14_L1 + Xtend
Concentration
0
5
10
15
Time (days post dose)

XENP35153 [1+1 Fab-scFv-Fc] - 38E2[B7H3]_H2_L1.1 x 1A7[CD28]_H1.14_L1 + Xtend
Concentration
0
5
10
15
Time (days post dose)

XENP37807 [2+1 mAb-scFv] - 2E4A3.189[B7H3]_H1.22_L1 x 1A7[CD28]_H1.14_L1 + Xtend
Concentration
0
5
10
15
Time (days post dose)

XENP37982 [2+1 mAb-scFv] - 3C4[B7H3]_H1_L1.1 x 1A7[CD28]_H1.14_L1 + Xtend
Concentration
0
5
10
15
Time (days post dose)

Figure 47

| | XENP34398 | XENP37808 | XENP34732 | XENP35153 |
|---|---|---|---|---|
| **Format** | 2+1 CLC | 2+1 CLC | 1 + 1 Fab-scFv-Fc | 1 + 1 Fab-scFv-Fc |
| **B7H3 Fv** | 2E4A3.189[B7H3]_H1.22_1A7_L1 | 2E4A3.189[B7H3]_H1.22_1A7_L1 | 6A1[B7H3]_H1L1 | 4F12[B7H3]_H2_L1.1 |
| **CD28 Fv** | 1A7[CD28]_H1.14_L1 | 1A7[CD28]_H1.1_L1 | 1A7[CD28]_H1.14_L1 | 1A7[CD28]_H1.14_L1 |
| **B7H3 Fv Source** | Phage | Phage | Rat | Rabbit |
| **CD28 Fv Source** | Phage | Phage | Phage | Phage |
| **B7H3 Fv Humanness** | 93% | 93% | 85% | 81% |
| **CD28 Fv Humanness** | 94% | 94% | 94% | 94% |
| **B7H3 Monovalent KD (nM)** | 7.6 | 7.6 | 8.1 | 0.5 |
| **CD28 KD (nM)** | 63 | 230 | 370 | 360 |
| **MDA-MB-231 EC50 (nM)** | 0.2 | 0.7 | 6 | 0.6 |
| **PK t1/2** | 3.3 to 5.0 | 3.4 to 4.3 | 5.4 to 6.1 | 4.2 to 5.4 |
| **DSF Tm1 and Tm2 (oC)** | 67.5, 78.5 | 67.5, 78.5 | 67.5, 80.0 | 67.5, 79.0 |
| **Sequence Liabilities** | none | none | none | NS (HCDR3); NS (LCDR1) |
| **Pros** | most potent; high humanness | high humanness | simplest bsAb format | simplest bsAb format |
| **Cons** | | | weak activity | rabbit-derived |

| | Antigen | $K_D$ | Sensorgram |
|---|---|---|---|
| XENP34717 (2E4A3.189) | huB7H3 (full) | 16 nM | |
| | huB7H3 (V1C1) | 21 nM | |
| | huB7H3 (V2C2) | 21 nM | |

| XENP34728 (6A1) | huB7H3 (full) | 4.3 nM |
|---|---|---|
| | huB7H3 (V1C1) | 4.4 nM |
| | huB7H3 (V2C2) | 6.4 nM |

| | Fit Model | $K_D$ | Sensorgram |
|---|---|---|---|
| **XENP34339 (2 + 1 CLC)** | 1:1 Langmuir | 96 nM (18 μg/mL) | |
| | Steady State | 150 nM (29 μg/mL) | |
| **XENP34389 (2 + 1 $Fab_2$-scFv-Fc)** | 1:1 Langmuir | 790 nM (140 μg/mL) | |
| | Steady State | 560 nM (96 μg/mL) | |

Figure 54A

>XENP31602 PSMA-H_H1L1_Fab-PSMA-H_H1L1_CH1_(G4S)2_[CD3]_H1.30_L1.47_scFv(GKPGS)4_(G4S)2-IgG1_pI(-)_Isosteric_A_/PVA_/S267K/L368D/K370S-Fc(222)_IgG1_PVA_/S267K/S364K/E357Q

Chain 1 - PSMA-H_H1_IgG1_pI(-)_Isosteric_A_/PVA_/S267K/L368D/K370S SEQ ID NO:1040
EVQLVQSGAEVKKPGASVKVSCKTSGYTFTEYTIHWVRQAPGQSLEWMGNINPNNGGTTYNQKFQGRVTITVDKSTS
TAYMELSSLRSEDTAVYYCAAGWNFDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK

Chain 2 - PSMA-H_H1_CH1_(G4S)2_[CD3]_H1.30_L1.47_scFv(GKPGS)4_(G4S)2_Fc(222)_IgG1_PVA_/S267K/S364K/E357Q SEQ ID NO:1041
EVQLVQSGAEVKKPGASVKVSCKTSGYTFTEYTIHWVRQAPGQSLEWMGNINPNNGGTTYNQKFQGRVTITVDKSTS
TAYMELSSLRSEDTAVYYCAAGWNFDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK

Chain 3 - PSMA-H_L1 Light Chain SEQ ID NO:1042
DIVMTQSPDSLAVSLGERATLSCRASQDVGTAVDWYQQKPDQSPKLLIYWASTRHTGVPDRFTGSGSGTDFTLTISS
LQAEDVAVYFCQQYNSYPLTFGAGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 54B

>XENP32220 PSMA-H_H1_L1.24_Fab-PSMA-H_H1_L1.24_Fab_(G4S)_[CD3]_L1.47_H1.32_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q

Chain 1 - PSMA-H_H1_IgG1_pI(-)_Isosteric_A_/PVA_/S267K/L368D/K370S SEQ ID NO:1043
EVQLVQSGAEVKKPGASVKVSCKTSGYTFTEYTIHWVRQAPGQSLEWMGNINPNNGGTTYNQKFQGRVTITVDKSTS
TAYMELSSLRSEDTAVYYCAAGWNFDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK

Chain 2 - PSMA-H_H1_(G4S)_[CD3]_L1.47_H1.32_scFv(GKPGS)4_Fc(222)_IgG1_C220S/PVA_/S267K/S364K/E357Q
SEQ ID NO:1044
EVQLVQSGAEVKKPGASVKVSCKTSGYTFTEYTIHWVRQAPGQSLEWMGNINPNNGGTTYNQKFQGRVTITVDKSTS
TAYMELSSLRSEDTAVYYCAAGWNFDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKANNYATYYADSVKGRFTISRDDSKNTLYLQMNSLRAEDTAVYYCVR
HGNFGDSYVSWFAYWGQGTLVTVSS/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK

Chain 3 - PSMA-H_L1.24 Light Chain SEQ ID NO:1045
DIVMTQSPDSLAVSLGERATLSCRASQDVGTAVDWYQQKPDQSPKLLIYYASTRHTGVPDRFTGSGSGTDFTLTISS
LQAEDVAVYFCQQYNSYPLTFGAGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

1) 1 µg/ml XENP31602
2) 1 µg/ml XENP34339

Figure 56A

| **CD3 High – [anti-CD3]_H1.30_L1.47_scFv** | | |
|---|---|---|
| | Sequence | SEQ ID NO: |
| scFv | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1046 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1047 |
| vhCDR1 | TYAMN | SEQ ID NO:1048 |
| vhCDR2 | RIRSKYNNYATYYADSVKG | SEQ ID NO:1049 |
| vhCDR3 | HGNFGDSYVSWFAY | SEQ ID NO:1050 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1051 |
| vlCDR1 | GSSTGAVTTSNYAN | SEQ ID NO:1052 |
| vlCDR2 | GTNKRAP | SEQ ID NO:1053 |
| vlCDR3 | ALWYSNHWV | SEQ ID NO:1054 |
| Linker | GKPGSGKPGSGKPGSGKPGS | SEQ ID NO:1055 |

Figure 56B

| CD3 High-Int #1 – [anti-CD3]_H1.32_L1.47_scFv | | |
|---|---|---|
| | Sequence | SEQ ID NO: |
| scFv | EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1056 |
| Variable Heavy (vh) Domain | EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS | SEQ ID NO:1057 |
| vhCDR1 | TYAMN | SEQ ID NO:1058 |
| vhCDR2 | RIRSKANNYATYYADSVKG | SEQ ID NO:1059 |
| vhCDR3 | HGNFGDSYVSWFAY | SEQ ID NO:1060 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1061 |
| vlCDR1 | GSSTGAVTTSNYAN | SEQ ID NO:1062 |
| vlCDR2 | GTNKRAP | SEQ ID NO:1063 |
| vlCDR3 | ALWYSNHWV | SEQ ID NO:1064 |
| Linker | GKPGSGKPGSGKPGSGKPGS | SEQ ID NO:1065 |

Figure 56C

| CD3 High-Int #2 – [anti-CD3]_H1.89_L1.47_scFv | | |
|---|---|---|
| | Sequence | SEQ ID NO: |
| scFv | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1066 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS | SEQ ID NO:1067 |
| vhCDR1 | TYAMN | SEQ ID NO:1068 |
| vhCDR2 | RIRSKYNNYATYYADSVKG | SEQ ID NO:1069 |
| vhCDR3 | HGNFGDEYVSWFAY | SEQ ID NO:1070 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1071 |
| vlCDR1 | GSSTGAVTTSNYAN | SEQ ID NO:1072 |
| vlCDR2 | GTNKRAP | SEQ ID NO:1073 |
| vlCDR3 | ALWYSNHWV | SEQ ID NO:1074 |
| Linker | GKPGSGKPGSGKPGSGKPGS | SEQ ID NO:1075 |

Figure 56D

| CD3 High-Int – [anti-CD3]_H1.90_L1.47_scFv | | |
|---|---|---|
| | Sequence | SEQ ID NO: |
| scFv | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1076 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | SEQ ID NO:1077 |
| vhCDR1 | TYAMN | SEQ ID NO:1078 |
| vhCDR2 | RIRSKYNNYATYYADSVKG | SEQ ID NO:1079 |
| vhCDR3 | HGNFGDPYVSWFAY | SEQ ID NO:1080 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1081 |
| vlCDR1 | GSSTGAVTTSNYAN | SEQ ID NO:1082 |
| vlCDR2 | GTNKRAP | SEQ ID NO:1083 |
| vlCDR3 | ALWYSNHWV | SEQ ID NO:1084 |
| Linker | GKPGSGKPGSGKPGSGKPGS | SEQ ID NO:1085 |

Figure 56E

| Anti-CD3-Intermediate – [anti-CD3]_H1.33_L1.47_scFv | | |
|---|---|---|
| | Sequence | SEQ ID NO: |
| scFv | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1086 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS | SEQ ID NO:1087 |
| vhCDR1 | TYAMN | SEQ ID NO:1088 |
| vhCDR2 | RIRSKYNNYATYYADSVKG | SEQ ID NO:1089 |
| vhCDR3 | HGNFGDSYVSWFDY | SEQ ID NO:1090 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1091 |
| vlCDR1 | GSSTGAVTTSNYAN | SEQ ID NO:1092 |
| vlCDR2 | GTNKRAP | SEQ ID NO:1093 |
| vlCDR3 | ALWYSNHWV | SEQ ID NO:1094 |
| Linker | GKPGSGKPGSGKPGSGKPGS | SEQ ID NO:1095 |

Figure 56F

| CD3 High-Int – [anti-CD3]_H1.31_L1.47_scFv | | |
|---|---|---|
| | Sequence | SEQ ID NO: |
| scFv | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1096 |
| Variable Heavy (vh) Domain | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1097 |
| vhCDR1 | TYAMS | SEQ ID NO:1098 |
| vhCDR2 | RIRSKYNNYATYYADSVKG | SEQ ID NO:1099 |
| vhCDR3 | HGNFGDSYVSWFAY | SEQ ID NO:1100 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1101 |
| vlCDR1 | GSSTGAVTTSNYAN | SEQ ID NO:1102 |
| vlCDR2 | GTNKRAP | SEQ ID NO:1103 |
| vlCDR3 | ALWYSNHWV | SEQ ID NO:1104 |
| Linker | GKPGSGKPGSGKPGSGKPGS | SEQ ID NO:1105 |

Figure 56G

| **CD3 High[VL-VH] – [anti-CD3] L1.47 H1.30 scFv** | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1106 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1107 |
| vlCDR1 | GSSTGAVTTSNYAN | SEQ ID NO:1108 |
| vlCDR2 | GTNKRAP | SEQ ID NO:1109 |
| vlCDR3 | ALWYSNHWV | SEQ ID NO:1110 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1111 |
| vhCDR1 | TYAMN | SEQ ID NO:1112 |
| vhCDR2 | RIRSKYNNYATYYADSVKG | SEQ ID NO:1113 |
| vhCDR3 | HGNFGDSYVSWFAY | SEQ ID NO:1114 |
| Linker | GKPGSGKPGSGKPGSGKPGS | SEQ ID NO:1115 |

Figure 56H

| CD3 High-Int #1[VL-VH] – [anti-CD3]_L1.47_H1.32_scFv | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS | SEQ ID NO:1116 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1117 |
| vlCDR1 | GSSTGAVTTSNYAN | SEQ ID NO:1118 |
| vlCDR2 | GTNKRAP | SEQ ID NO:1119 |
| vlCDR3 | ALWYSNHWV | SEQ ID NO:1120 |
| Variable Heavy (vh) Domain | EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS | SEQ ID NO:1121 |
| vhCDR1 | TYAMN | SEQ ID NO:1122 |
| vhCDR2 | RIRSKANNYATYYADSVKG | SEQ ID NO:1123 |
| vhCDR3 | HGNFGDSYVSWFAY | SEQ ID NO:1124 |
| Linker | GKPGSGKPGSGKPGSGKPGS | SEQ ID NO:1125 |

Figure 56I

| CD3 High-Int #2[VL-VH] – [anti-CD3] L1.47 H1.89 scFv | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS | SEQ ID NO:1126 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1127 |
| vlCDR1 | GSSTGAVTTSNYAN | SEQ ID NO:1128 |
| vlCDR2 | GTNKRAP | SEQ ID NO:1129 |
| vlCDR3 | ALWYSNHWV | SEQ ID NO:1130 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS | SEQ ID NO:1131 |
| vhCDR1 | TYAMN | SEQ ID NO:1132 |
| vhCDR2 | RIRSKYNNYATYYADSVKG | SEQ ID NO:1133 |
| vhCDR3 | HGNFGDEYVSWFAY | SEQ ID NO:1134 |
| Linker | GKPGSGKPGSGKPGSGKPGS | SEQ ID NO:1135 |

Figure 56J

| **CD3 High-Int[VL-VH] – [anti-CD3] L1.47 H1.90 scFv** | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | SEQ ID NO:1136 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1137 |
| vlCDR1 | GSSTGAVTTSNYAN | SEQ ID NO:1138 |
| vlCDR2 | GTNKRAP | SEQ ID NO:1139 |
| vlCDR3 | ALWYSNHWV | SEQ ID NO:1140 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | SEQ ID NO:1141 |
| vhCDR1 | TYAMN | SEQ ID NO:1142 |
| vhCDR2 | RIRSKYNNYATYYADSVKG | SEQ ID NO:1143 |
| vhCDR3 | HGNFGDPYVSWFAY | SEQ ID NO:1144 |
| Linker | GKPGSGKPGSGKPGSGKPGS | SEQ ID NO:1145 |

Figure 56K

| Anti-CD3-Intermediate[VL-VH] – [anti-CD3]_L1.47_H1.33_scFv | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS | SEQ ID NO:1146 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1147 |
| vlCDR1 | GSSTGAVTTSNYAN | SEQ ID NO:1148 |
| vlCDR2 | GTNKRAP | SEQ ID NO:1149 |
| vlCDR3 | ALWYSNHWV | SEQ ID NO:1150 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS | SEQ ID NO:1151 |
| vhCDR1 | TYAMN | SEQ ID NO:1152 |
| vhCDR2 | RIRSKYNNYATYYADSVKG | SEQ ID NO:1153 |
| vhCDR3 | HGNFGDSYVSWFDY | SEQ ID NO:1154 |
| Linker | GKPGSGKPGSGKPGSGKPGS | SEQ ID NO:1155 |

Figure 56L

| CD3 High-Int[VL-VH] – [anti-CD3]_L1.47_H1.31_scFv | | |
|---|---|---|
| | Sequence | SEQ ID NO: |
| scFv | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1156 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | SEQ ID NO:1157 |
| vlCDR1 | GSSTGAVTTSNYAN | SEQ ID NO:1158 |
| vlCDR2 | GTNKRAP | SEQ ID NO:1159 |
| vlCDR3 | ALWYSNHWV | SEQ ID NO:1160 |
| Variable Heavy (vh) Domain | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | SEQ ID NO:1161 |
| vhCDR1 | TYAMS | SEQ ID NO:1162 |
| vhCDR2 | RIRSKYNNYATYYADSVKG | SEQ ID NO:1163 |
| vhCDR3 | HGNFGDSYVSWFAY | SEQ ID NO:1164 |
| Linker | GKPGSGKPGSGKPGSGKPGS | SEQ ID NO:1165 |

Figure 57A
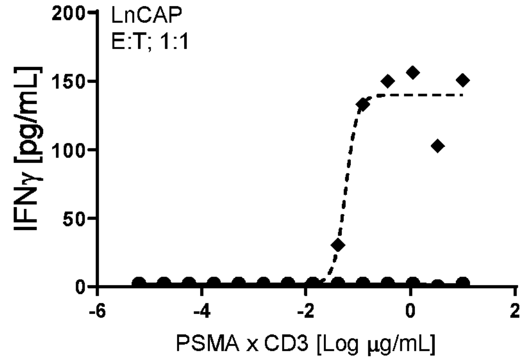
Figure 57B
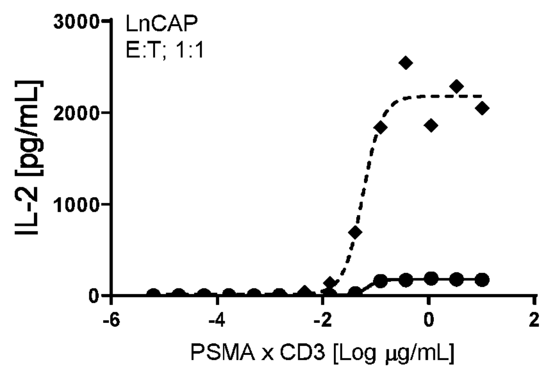
Figure 57C
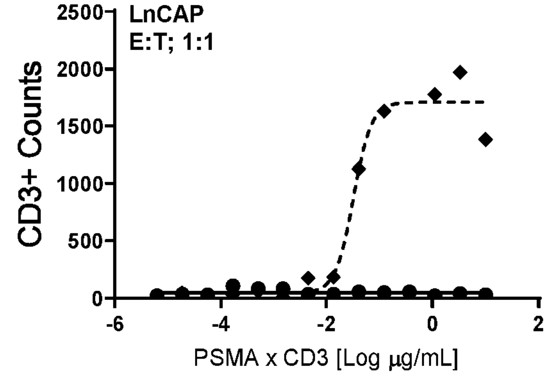
XENP31602 + 1 µg/ml XENP34339
XENP31602 + PBS
LNCaP
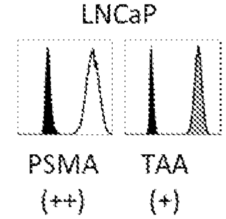
PSMA (++) TAA (+)

Figure 58A
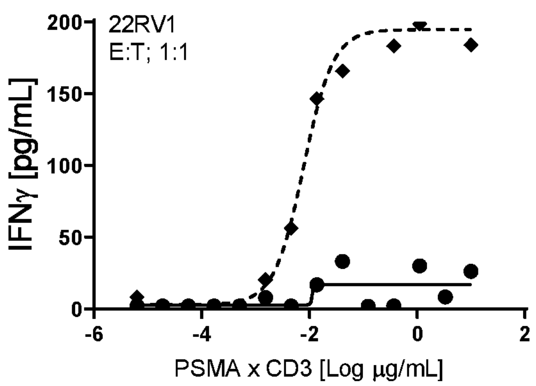
Figure 58B
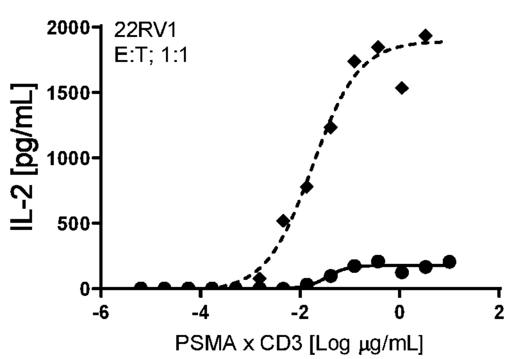
Figure 58C
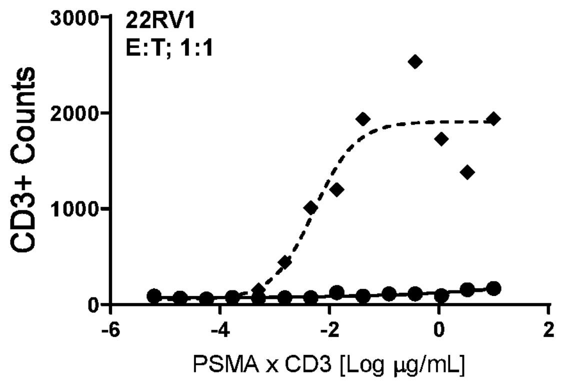
XENP31602 + 1 µg/ml XENP34339
XENP31602 + PBS
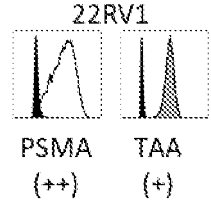

Figure 59A
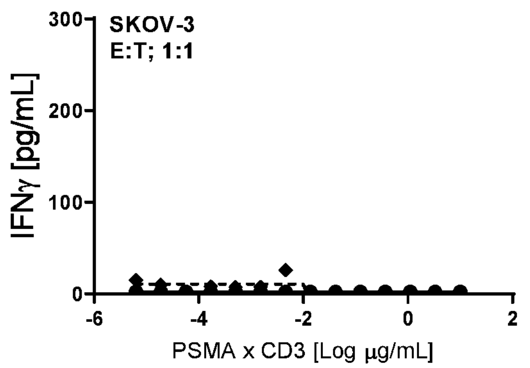
Figure 59B
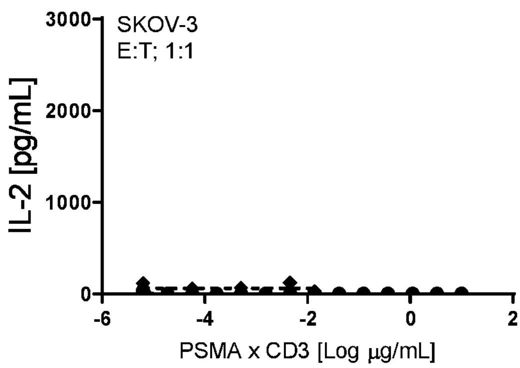
Figure 59C
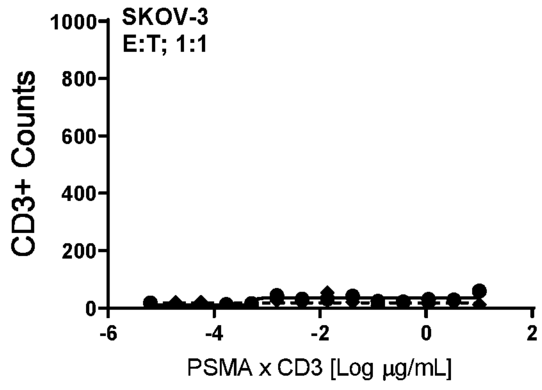
XENP31602 + 1 µg/ml XENP34339
XENP31602 + PBS
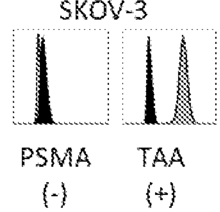

Figure 60A
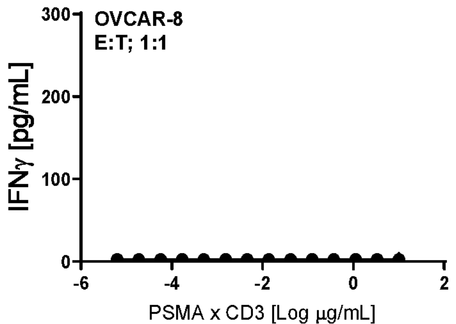
Figure 60B
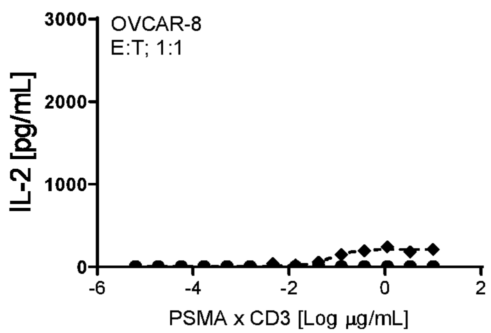
Figure 60C
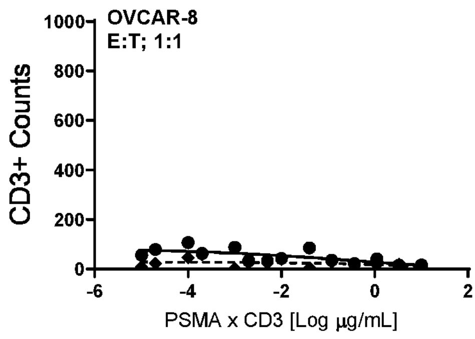
XENP31602 + 1 µg/ml XENP34339
XENP31602 + PBS
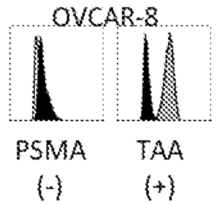

Change in Tumor Volume (mm3)
1 dead
1 dead
2 dead
PBS
CD3bsAb1, 0.5 mg/Kg
CD3bsAb2, 0.5 mg/Kg
XENP34339, 5 mg/Kg + CD3bsAb1, 0.5 mg/Kg
XENP34339, 5 mg/Kg + CD3bsAb2, 0.5 mg/Kg PBS
CD3bsAb1, 0.5 mg/Kg
CD3bsAb2, 0.5 mg/Kg
XENP34339, 5 mg/Kg + CD3bsAb1, 0.5 mg/Kg
XENP34339, 5 mg/Kg + CD3bsAb2, 0.5 mg/Kg CD45+
CD45+ cell counts /45μl blood
15000
10000
5000
0

CD4+
CD4+ cell counts /45μl blood
2500
2000
1500
1000
500
0

CD8+
CD8+ cell counts /45μl blood
2000
1500
1000
500
0

CD4+
CD4+Ki67+ cell counts /45μl blood
2000
1500
1000
500
0

CD8+
CD8+Ki67+ cell counts /45μl blood
1500
1000
500
0
(A) huPBMC + PBS
(B) XENP34339 - 0.3 mg/kg
PSMAxCD3
(D) XENP32220 - 1 mg/kg
(F) XENP 32220 - 6 mg/kg
PSMAxCD3 + B7H3xCD28
(G) XENP32220, 1 mg/kg + XENP34339, 0.3 mg/Kg
(H) XENP32220, 6 mg/kg + XENP34339, 0.3 mg/Kg CD4+
CD4+ gMFI: CD25
5000
4000
3000
2000
1000
0

CD4+
CD4+ gMFI: PD1
6000
4000
2000
0

CD8+
CD8+ gMFI: CD25
6000
4000
2000
0

CD8+
CD8+ gMFI: PD1
3000
2000
1000
0
PSMAxCD3
PSMAxCD3 + B7H3xCD28
(A) huPBMC + PBS
(B) XENP34339 - 0.3 mg/kg
(D) XENP32220 - 1 mg/kg
(F) XENP 32220 - 6 mg/kg
(G) XENP32220, 1 mg/kg + XENP34339, 0.3 mg/Kg
(H) XENP32220, 6 mg/kg + XENP34339, 0.3 mg/Kg

Baseline-corrected Tumor Measurements

Day 9

* p < 0.05 vs. PBS

† p < 0.05 vs. B7H3 x CD3

Change in Tumor Volume (mm3)

500 450 400 350 300 250 200 150 100 50 0 -50 -100 -150 -200

* *† *

PBS

B7H3 x CD3 bsAb, 0.5 mg/kg

XENP35612, 1 mg/kg

XENP34339, 0.3 mg/kg + B7H3 x CD3 bsAb, 0.5 mg/Kg

XENP35612, 1 mg/kg + B7H3 x CD3 bsAb, 0.5 mg/Kg

Figure 69

>XENP29154_TGN1412_hu5.11A1[CD28]_H1L1_IgG4_K447del

XENP29154_TGN1412_hu5.11A1[CD28]_H1_IgG4_K447del Heavy Chain SEQ ID NO:1166

EVQLVESGGGLVQPGGSLRLSCAASGFTFSDSWIHWVRQAPGKGLEWVAWISPYGGSTYYADSVKGRFTI
SADTSKNTAYLQMNSLRAEDTAVYYCARRHWPGGFDYWGQGTLVTVSS/ASTKGPSVFPLAPSSKSTSGG
TAALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSKLTVDKSRWQQ
GNVFSCSVMHEALHNHYTQKSLSLSPGK

XENP29154 TGN1412_hu5.11A1[CD28]_ L1 Light Chain SEQ ID NO:1167

DIQMTQSPSSLSASVGDRVTITCRASQDVSTAVAWYQQKPGKAPKLLIYSASFLYSGVPSRFSGSGSGTD
FTLTISSLQPEDFATYYCQQYLYHPATFGQGTKVEIK/RTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTKSF
NRGEC

● PBS
■ XENP34339
◆ TGN1412 (XENP29154)

Figure 71A
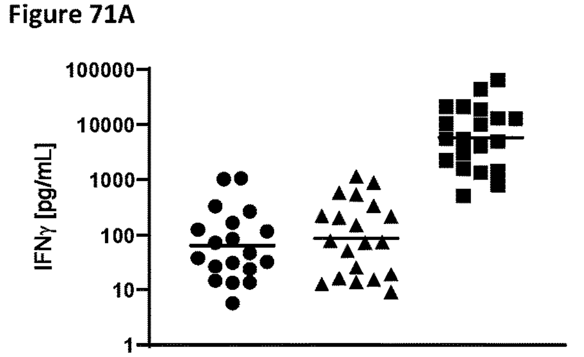
Figure 71B
IL-2 [pg/mL]
1000
100
10
1
0.1
Figure 71C
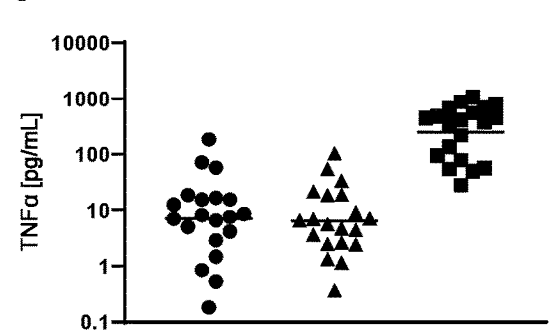
PBS
XENP37808 [10ug/well]
TGN1412 IgG4 [10ug/well]

anti-CD3 scFv transfected HEK cells B7H3+ anti-CD3 scFv transfected HEK cells B7H3-

XENP34398 B7H3 (2E4) x CD28 (1A7_H1.14) 2+1 CLC (Xtend) + B7H3 x CD3

XENP37808 B7H3 (2E4) x CD28 (1A70H1.1) 2+1 CLC (Xtend) + B7H3 x CD3

B7H3 x CD3

XENP34398 B7H3 (2E4) x CD28 (1A7_H1.14) 2+1 CLC (Xtend) + B7H3 x CD3

XENP37808 B7H3 (2E4) x CD28 (1A7_H1.1) 2+1 CLC (Xtend) + B7H3 x CD3

B7H3 x CD3

Figure 74A
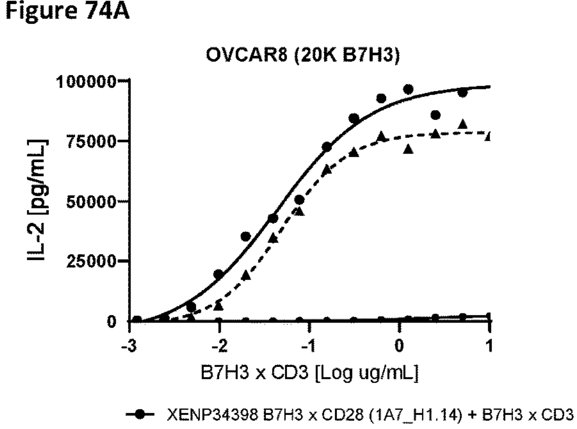
Figure 74B
22RV1-NLR (170K B7H3)
IL-2 [pg/mL]
25000
20000
15000
10000
5000
0
-4 -3 -2 -1 0 1
B7H3 x CD28 mAb [Log µg/mL]
XENP34398 B7H3 x CD28 (1A7_H1.14) 2+1 CLC + B7H3 x CD3
XENP37808 B7H3 x CD28 (1A7_H1.1) 2+1 CLC + B7H3 x CD3
Figure 74C
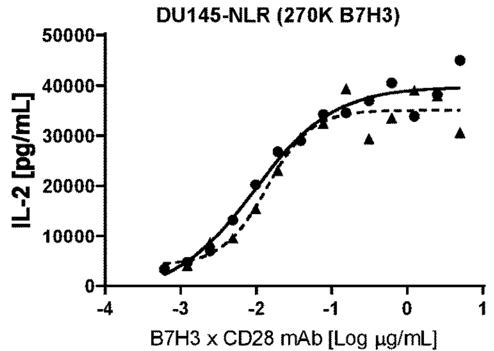
XENP34398 B7H3 x CD28 (1A7_H1.14) + B7H3 x CD3
XENP37808 B7H3 x CD28 (1A7_H1.1) + B7H3 x CD3

Figure 75

| 2E4A3.189 VH | SEQ | SEQ ID | |
|---|---|---|---|
| HFR1 | QVQLVQSGAEVKKPGASVKVSCKASG$X_1X_2$F$X_3$ | 1168 | $X_1$ is selected from Y, L; $X_2$ is selected from I, T, P, A, S, G, L, F; and $X_3$ is selected from T, I, V, K, E, S |
| HCDR1 | $X_1X_2$YMH | 1169 | $X_1$ is selected from N, D, Q, E, I, F; and $X_2$ is selected from Y, N, H, F, V |
| HFR2 | WVRQAPGQGLEWMG | 1170 | |
| HCDR2 | I$X_1X_2$P$X_3X_4$G$X_5X_6X_7$YAQKFQG | 1171 | X1 is selected from I, L; X2 is selected from S, A, F, G; X3 is selected from S, I, V, L, Q, A, G; X4 is selected from A, S, V, G, T; X5 is selected from T, R, S; X6 is selected from T, W, I; and X7 is selected from S, D, A, N, I, L, Q |
| HFR3 | R$X_1$TMTRDTSTSTVYMELSSLRSEDTAVYYCAR | 1172 | X1 is selected from V, F |
| HCDR3 | $X_1$G$X_2$SSPR$X_3$DY | 1173 | X1 is selected from G, A; X2 is selected from G, F, W, L, M; and X3 is selected from L, S, V, G, Q |
| HFR4 | WGQGTLVTVSS | 1174 | |
| **2E4A3.189 VL** | | | |
| LFR1 | DIQMTQSPSSLSASVGDRVTITC | 1175 | |
| LCDR1 | RASQSISSYLN | 1176 | |
| LFR2 | WYQQKPGKAPKLLIY | 1177 | |
| LCDR2 | AASSLQS | 1178 | |
| LFR3 | GVPSRFSGSGSGTDFTLTISSLQPEDFATYYC | 1179 | |
| LCDR3 | QQSYSTPYT | 1180 | |
| LFR4 | FGQGTKLEIK | 1181 | |

ANTI-CD28 COMPOSITIONS

PRIORITY

This application is a continuation of U.S. patent application Ser. No. 17/558,372, filed Dec. 21, 2021, which is a continuation of U.S. patent application Ser. No. 17/407,135, filed Aug. 19, 2021 which claims the benefit of U.S. Provisional Patent Application Nos. 63/067,834, filed Aug. 19, 2020 and 63/092,272, filed Oct. 15, 2020 which are hereby incorporated by reference in their entireties.

SEQUENCE LISTING INCORPORATION PARAGRAPH

The instant application contains a Sequence Listing which has been submitted electronically in XML file format and is hereby incorporated by reference in its entirety. Said XML copy, created on Dec. 21, 2022, is named 067461-5272-US02_SL.xml and is 1,625,920 bytes in size.

BACKGROUND

The natural immune response against tumor dispatches immune effector cells such as natural killer (NK) cells and T cells to attack and destroy tumor cells. Tumor infiltrating lymphocytes (TILs) often express multiple immune checkpoint receptors (e.g., PD-1, CTLA-4) and costimulatory receptors (e.g., ICOS, 4-1BB, OX40, GITR, and CD28). TILs lose their cytotoxic ability over time due to upregulation of inhibitory immune checkpoints. While checkpoint blockade has demonstrated increased clinical response rates relative to other treatment options, many patients still fail to achieve a response to checkpoint blockade. Engagement of costimulatory receptors on TILs could provide a positive signal capable of overcoming negative signals of immune checkpoints. Preclinical and clinical studies of agonistic costimulatory receptor antibodies have indeed demonstrated that agonism of costimulatory receptors can result in impressive anti-tumor responses, activating T cells to attack tumor cells.

It is also important for cancer therapy to enhance anti-tumor activity by specifically destroying tumor cells while minimizing peripheral toxicity. In this context, it is crucial that only T cells in the presence of the target tumor cells are provided a costimulatory signal. However, agonism of costimulatory receptors with monospecific full-length antibodies is likely nondiscriminatory with regards to TILs vs. peripheral T cells vs. autoantigen-reactive T cells that contribute to autoimmune toxicities. For instance, urelumab, a monospecific, nondiscriminatory, pan-4-1BB agonist antibody, exhibited significant liver toxicity in early phase clinical trials (Segal et al., 2016). Thus, there remains a need for novel immune response enhancing compositions for the treatment of cancers.

SUMMARY

Provided herein are novel anti-CD28 compositions, including anti-CD28 x anti-TAA (e.g., αCD28 x αB7H3) antibodies and methods of using such antibodies for the treatment of cancers. Subject anti-CD28 x anti-TAA antibodies are capable of agonistically binding to CD28 costimulatory molecules on T cells and a tumor associated antigen (e.g., B7H3) on tumor cells. Thus, such antibodies selectively enhance anti-tumor activity at tumor sites while minimizing peripheral toxicity. The subject antibodies provided herein are particularly useful in combination with other anti-cancer therapies, including, for example, checkpoint inhibitors. Also provided herein are novel αCD28 and αB7H3 binding domains.

In a first aspect, provided herein is a heterodimeric antibody comprising: a) a first monomer comprising, from N-terminus to C-terminus, a VH1-CH1-linker-VH1-CH1-hinge-CH2—CH3, wherein the VH1s are each a first variable heavy domain and CH2-CH3 is a first Fc domain; b) a second monomer comprising, from N-terminus to C-terminus, a VH2-CH1-hinge-CH2-CH3, wherein VH2 is a second variable heavy domain and CH2-CH3 is a second Fc domain; and c) a common light chain comprising, from N-terminus to C-terminus, VL-CL, wherein VL is a variable light domain and CL is a constant light domain, wherein the common light chain is separately paired with each VH1-CH1 in the first monomer and the VH2-CH1 in the second monomer, wherein the VH1 and the VL together form a first antigen binding domain (ABD), and the VH2 and the VL together form a second ABD, wherein one of the first and second ABDs binds human CD28 and the other of the first and second ABDs bind human B7H3.

In some embodiments, the first ABD binds human CD28 and the second binds human B7H3. In certain embodiments, the first ABD binds human B7H3 and the second binds human CD28.

In some embodiments, the amino acid sequence of the VH1 domain is selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and wherein the amino acid sequence of the VL domain is SEQ ID NO:874.

In some embodiments, the amino acid sequence of the VH2 domain is selected from the group consisting of SEQ ID NO: 585, SEQ ID NO:870, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, and SEQ ID NO:651.

In certain embodiments, the first Fc domain and second Fc domain are each variant Fc domains.

In some embodiments of the heterodimeric antibody, the first and second Fc domains comprise a set of heterodimerization skew variants selected from the following heterodimerization variants: S364K/E357Q: L368D/K370S; S364K: L368D/K370S; S364K: L368E/K370S; D401K: T411E/K360E/Q362E; and T366W: T366S/L368A/Y407V, wherein numbering is according to EU numbering. In exemplary embodiments, the first and second Fc domains comprise heterodimerization skew variants S364K/E357Q L368D/K370S.

In some embodiments, the first and second Fc domains each comprise one or more ablation variants. In some embodiments, the one or more ablation variants are E233P/L234V/L235A/G236del/S267K, wherein numbering is according to EU numbering.

In some embodiments, one of the first or second monomer further comprises a pI variant. In some embodiments, the CH1-hinge-CH2-CH3 of the second monomer comprises pI variants N208D/Q295E/N384D/Q418E/N421D, wherein numbering is according to EU numbering.

In some embodiments, the CH1-hinge-CH2-CH3 of the second monomer comprises amino acid variants L368D/K370S/N208D/Q295E/N384D/Q418E/N421D/E233P/L234V/L235A/G236del/S267 K, and the first Fc domain comprises amino acid variants S364K/E357Q/E233P/L234V/L235A/G236del/S267K, wherein numbering is according to EU numbering.

In exemplary embodiments, the first and second variant Fc domains each comprise amino acid variants 428L/434S.

In some embodiments, the second monomer comprises the amino acid sequence of SEQ ID NO:1019, the first monomer comprises the amino acid sequence of SEQ ID NO:1020, and the light chain has the amino acid sequence of SEQ ID NO:1021.

In another aspect, provided herein is a heterodimeric antibody comprising: a) a first monomer comprising, from N-terminus to C-terminus, a VH1-CH1-hinge-CH2-CH3, wherein VH1 is a first variable heavy domain and CH2-CH3 is a first Fc domain; b) a second monomer comprising, from N-terminus to C-terminus, a VH2-CH1-hinge-CH2-CH3, wherein VH2 is a second variable heavy domain and CH2-CH3 is a second Fc domain; and c) a common light chain comprising, from N-terminus to C-terminus, VL-CL, wherein VL is a variable light domain and CL is a constant light domain, wherein the first VH domain and the VL domain together form a first ABD, and the second VH domain and the VL domain together form a second ABD, and wherein one of the first and second ABDs binds human CD28 and the other of the first and second ABDs bind human B7H3.

In certain embodiments, the amino acid sequence of the VH1 domain is selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and wherein the amino acid sequence of the VL domain is SEQ ID NO:874.

In some embodiments, the amino acid sequence of the VH2 domain is selected from the group consisting of SEQ ID NO:585, SEQ ID NO:870, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, and SEQ ID NO:651.

In certain embodiments, the first Fc domain and second Fc domain are each variant Fc domains.

In some embodiments, the first and second Fc domains comprise a set of heterodimerization skew variants selected from the following heterodimerization variants: S364K/

E357Q: L368D/K370S; S364K: L368D/K370S; S364K: L368E/K370S; D401K: T411E/K360E/Q362E; and T366W: T366S/L368A/Y407V, wherein numbering is according to EU numbering. In certain embodiments, the first and second Fc domains comprise heterodimerization skew variants S364K/E357Q: L368D/K370S.

In some embodiments, the first and second Fc domains each comprise one or more ablation variants. In certain embodiments, the one or more ablation variants are E233P/L234V/L235A/G236del/S267K, wherein numbering is according to EU numbering.

In certain embodiments, one of the first or second monomer further comprises a pI variant. In exemplary embodiments, the CH1-hinge-CH2-CH3 of the first monomer comprises pI variants N208D/Q295E/N384D/Q418E/N421D, wherein numbering is according to EU numbering.

In some embodiments, the CH1-hinge-CH2-CH3 of the first monomer comprises amino acid variants L368D/K370S/N208D/Q295E/N384D/Q418E/N421D/E233P/L234V/L235A/G236del/5267 K, and the second Fc domain comprises amino acid variants S364K/E357Q/E233P/L234V/L235A/G236del/S267K, wherein numbering is according to EU numbering.

In some embodiments, the first and second variant Fc domains each comprise amino acid variants 428L/4345.

In another aspect, provided herein is a heterodimeric antibody comprising: a) a first monomer comprising from N-terminal to C-terminal, VH1-CH1-first domain linker-scFv-second domain linker-CH2-CH3, wherein VH1 is a first variable heavy domain, scFv is an anti-CD28 scFv, and CH2-CH3 is a first Fc domain; b) a second monomer comprising from N-terminal to C-terminal a VH1-CH1-hinge-CH2-CH3, wherein CH2-CH3 is a second Fc domain; and c) a light chain comprising, from N-terminus to C-terminus, VL1-CL, wherein VL1 is a variable light domain and CL is a constant light domain, wherein each of the VH1 domain and the first VL1 domain together form a first antigen binding domain (ABD) and the scFv comprises a second VH domain (VH2), a scFv linker, and a second VL domain (VL2), and the VH2 and the VL2 form a second ABD, wherein one of the first and second ABDs bind human CD28 and the other of the first and second ABDs bind a tumor target antigen (TTA).

In certain embodiments, the first ABDs bind human CD28 and the second ABD binds a TTA. In some embodiments, the first ABDs bind a TTA and the second ABD binds human CD28.

In some embodiments, the scFv comprises, from N- to C-terminal, VL2-scFv linker-VH2. In some embodiments, the scFv comprises, from N- to C-terminal, VH2-scFv linker-VL2.

In some embodiments, the amino acid sequence of the VH2 is selected from the group consisting of SEQ ID NO:870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:1198, SEQ ID NO:1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, and SEQ ID NO:651; and wherein the amino acid sequence of the VL2 is selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In certain embodiments, the TTA is human B7H3.

In some embodiments, the first Fc domain and second Fc domain are each variant Fc domains.

In exemplary embodiments, the first and second Fc domains comprise a set of heterodimerization skew variants selected from the following heterodimerization variants: S364K/E357Q: L368D/K370S; S364K: L368D/K370S; S364K: L368E/K370S; D401K: T411E/K360E/Q362E; and T366W: T366S/L368A/Y407V, wherein numbering is according to EU numbering. In some embodiments, the first and second Fc domains comprise heterodimerization skew variants S364K/E357Q: L368D/K370S.

In some embodiments, the first and second Fc domains each comprise one or more ablation variants. In certain embodiments, the one or more ablation variants are E233P/L234V/L235A/G236del/S267K, wherein numbering is according to EU numbering.

In some embodiments, one of the first or second monomer further comprises a pI variant. In exemplary embodiments, the CH1-hinge-CH2-CH3 of the second monomer comprises pI variants N208D/Q295E/N384D/Q418E/N421D, wherein numbering is according to EU numbering.

In exemplary embodiments, the CH1-hinge-CH2-CH3 of the second monomer comprises amino acid variants L368D/K370S/N208D/Q295E/N384D/Q418E/N421D/E233P/L234V/L235A/G236del/5267 K, and the first Fc domain comprises amino acid variants S364K/E357Q/E233P/L234V/L235A/G236del/S267K, wherein numbering is according to EU numbering.

In certain embodiments, the first and second variant Fc domains each comprise amino acid variants 428L/4345.

In one aspect, provided herein is a heterodimeric antibody comprising: a) a first monomer comprising: i) a scFv comprising a first variable heavy domain, an scFv linker and a first variable light domain; and ii) a first Fc domain, wherein the scFv is covalently attached to the N-terminus of the first Fc domain using a domain linker; b) a second monomer comprising, from N-terminus to C-terminus, a VH1-CH1-hinge-CH2-CH3, wherein VH is a first variable heavy domain and CH2-CH3 is a second Fc domain; and c) a light chain comprising, from N-terminus to C-terminus, VL1-CL, wherein VL1 is a variable light domain and CL is a constant light domain, wherein the VH1 and the VL1 together form a first ABD and wherein the scFv comprises a second VH domain (VH2), a scFv linker, and a second VL domain (VL2), wherein the VH2 and the VL2 together form a second ABD, and wherein one of the first ABD and second ABD binds CD28 and the other of the first ABD and second ABD binds a TTA.

In some embodiments, the scFv comprises, from N- to C-terminal, VL2-scFv linker-VH2. In certain embodiments, the scFv comprises, from N- to C-terminal, VH2-scFv linker-VL2.

In certain embodiments, the second ABD binds to human CD28 wherein the amino acid sequence of the VH2 is selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO: 1198, SEQ ID NO: 1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, and SEQ ID NO:651; and wherein the amino acid sequence of the VL2 is selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, the first Fc domain and second Fc domain are each variant Fc domains.

In certain embodiments, the first and second Fc domains comprise a set of heterodimerization skew variants selected from the following heterodimerization variants: S364K/E357Q: L368D/K370S; S364K: L368D/K370S; S364K: L368E/K370S; D401K: T411E/K360E/Q362E; and T366W: T366S/L368A/Y407V, wherein numbering is according to EU numbering. In exemplary embodiments, the first and second Fc domains comprise heterodimerization skew variants S364K/E357Q: L368D/K370S.

In certain embodiments, the first and second Fc domains each comprise one or more ablation variants. In some embodiments, the one or more ablation variants are E233P/L234V/L235A/G236del/S267K, wherein numbering is according to EU numbering.

In certain embodiments, one of the first or second monomer further comprises a pI variant. In exemplary embodiments, the CH1-hinge-CH2-CH3 of the second monomer comprises pI variants N208D/Q295E/N384D/Q418E/N421D, wherein numbering is according to EU numbering.

In exemplary embodiments, the CH1-hinge-CH2-CH3 of the second monomer comprises amino acid variants L368D/K370S/N208D/Q295E/N384D/Q418E/N421D/E233P/L234V/L235A/G236del/S267 K, and the first Fc domain comprises amino acid variants S364K/E357Q/E233P/L234V/L235A/G236del/S267K, wherein numbering is according to EU numbering.

In some embodiments, the first and second variant Fc domains each comprise amino acid variants 428L/434S.

In another aspect, provided herein is a heterodimeric antibody comprising: a) a first monomer comprising from N-terminal to C-terminal, VH1-CH1-hinge-CH2-CH3-domain linker-scFv, wherein VH1 is a first variable heavy domain, scFv is an anti-CD28 scFv, and CH2-CH3 is a first Fc domain; b) a second monomer comprising from N-terminal to C-terminal a VH1-CH1-hinge-CH2-CH3, wherein CH2-CH3 is a second Fc domain; and c) a light chain comprising, from N-terminus to C-terminus, VL1-CL, wherein VL1 is a variable light domain and CL is a constant light domain, wherein each of the VH1 domain and the first VL1 domain together form a first antigen binding domain (ABD) and the scFv comprises a second VH domain (VH2), a scFv linker, and a second VL domain (VL2), and the VH2 and the VL2 together form a second ABD, wherein one of the first and second ABDs bind human CD28 and the other of the first and second ABDs bind a tumor target antigen (TTA).

In certain embodiments, the first ABD bind human CD28 and the second ABD binds a TTA. In some embodiments, the first ABD bind a TTA and the second ABD binds human CD28.

In certain embodiments, the scFv comprises, from N- to C-terminal, VL2-scFv linker-VH2. In some embodiments, the scFv comprises, from N- to C-terminal, VH2-scFv linker-VL2.

In certain embodiments, the amino acid sequence of the VH2 is selected from the group consisting of SEQ ID NO:870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO: 1198, SEQ ID NO: 1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, and SEQ ID NO:651; and wherein the amino acid sequence of the VL2 is selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, the TTA is human B7H3.

In some embodiments, the first Fc domain and second Fc domain are each variant Fc domains. In some embodiments, the first and second Fc domains comprise a set of heterodimerization skew variants selected from the following heterodimerization variants: S364K/E357Q: L368D/K370S; S364K: L368D/K370S; S364K: L368E/K370S; D401K: T411E/K360E/Q362E; and T366W: T366S/L368A/Y407V, wherein numbering is according to EU numbering. In certain embodiments, the first and second Fc domains comprise heterodimerization skew variants S364K/E357Q: L368D/K370S.

In some embodiments, the first and second Fc domains each comprise one or more ablation variants. In certain embodiments, the one or more ablation variants are E233P/L234V/L235A/G236del/S267K, wherein numbering is according to EU numbering.

In some embodiments, one of the first or second monomer further comprises a pI variant. In exemplary embodiments, the CH1-hinge-CH2-CH3 of the second monomer comprises pI variants N208D/Q295E/N384D/Q418E/N421D, wherein numbering is according to EU numbering.

In some embodiments, the CH1-hinge-CH2-CH3 of the second monomer comprises amino acid variants L368D/K370S/N208D/Q295E/N384D/Q418E/N421D/E233P/L234V/L235A/G236del/5267 K, and the first Fc domain comprises amino acid variants S364K/E357Q/E233P/L234V/L235A/G236del/S267K, wherein numbering is according to EU numbering.

In exemplary embodiments, the first and second variant Fc domains each comprise amino acid variants 428L/4345.

In another aspect, provided herein is a nucleic acid composition comprising: a) a first nucleic acid encoding the first monomer of any of the heterodimeric antibodies described herein; b) a second nucleic acid encoding the second monomer of the heterodimeric antibody; and c) a third nucleic acid encoding the light chain of the heterodimeric antibody, respectively. Also provided herein are expression vector compositions that include expression vectors comprising one or more of the first, second and third nucleic acids, host cells that include such expression vector compositions, and methods of making the heterodimeric antibodies described herein.

In another aspect, provided herein is a method of treating cancer in a patient in need thereof, comprising administering to the patient a heterodimeric antibody provided herein.

In another aspect, provided herein is a method of treating cancer in a patient in need thereof, comprising administering to the patient: a) a heterodimeric antibody described herein, wherein the TTA is human B7H3; and b) a bispecific antibody that binds CD3 and B7H3.

In yet another aspect, provided herein is a method of treating cancer in a patient in need thereof, comprising administering to the patient: a) a heterodimeric antibody described herein, wherein the TTA is human B7H3; and b) a checkpoint inhibitor selected from the group consisting of an anti-PD-1 antibody and an anti-PD-L1 antibody.

In yet another aspect, provided herein is a composition comprising an anti-CD28 ABD comprising: a) a variable heavy domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO: 1198, SEQ ID NO: 1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672; and b) variable light domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756. In some embodiments, the composition is an antibody comprising: a) a heavy chain comprising the VH-CH1-hinge-CH2-CH3; and b) a light chain comprising the VL-CL.

In another aspect, provided herein is a composition comprising an anti-B7H3 ABD comprising: a) a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and b) variable light domain having the amino acid sequence selected from the group consisting of SEQ ID NO:874 and SEQ ID NO: 932.

In one aspect, provided herein is composition comprising an anti-B7H3 ABD comprising: a) a variable heavy domain having the amino acid sequence of SEQ ID NO:946; and b) a variable light domain having the amino acid sequence of SEQ ID NO:950.

In another aspect, provided herein is composition comprising an anti-B7H3 ABD comprising: a) a variable heavy domain having the amino acid sequence of SEQ ID NO:956; and b) a variable light domain having the amino acid sequence of SEQ ID NO:960.

In one aspect, provided herein is a composition comprising an anti-B7H3 ABD comprising: a) a variable heavy domain having the amino acid sequence of SEQ ID NO:964; and b) a variable light domain having the amino acid sequence of SEQ ID NO:968.

In another aspect, provided herein is a composition comprising an anti-B7H3 ABD comprising: a) a variable heavy domain having the amino acid sequence of SEQ ID NO:972; and b) a variable light domain having the amino acid sequence of SEQ ID NO:976.

In some embodiments, the composition is an antibody comprising: a) a heavy chain comprising the VH linked to —CH1-hinge-CH2-CH3; and b) a light chain comprising the VL linked to-CL.

In another aspect, provided herein is a nucleic acid composition comprising: a) a first nucleic acid encoding the VH of any of the anti-CD28 ABDs or anti-B7H3 ABDs described herein; and b) a second nucleic acid encoding the VL of the anti-CD28 or anti-B7H3 ABD, respectively. Also provided herein are expression vector compositions that include expression vectors comprising one or more of the first, and second nucleic acids, host cells that include such nucleic acid compositions or expression vector compositions, and methods of making the anti-CD28 ABDs or anti-B7H3 ABDs compositions described herein.

In one aspect, provided herein is a composition that includes a CD28 antigen binding domain (ABD). The CD28 ABD includes the variable heavy complementary determining regions 1-3 (vhCDR1-3) and the variable light complementary determining regions (vlCDR1-3) of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]H1L1.

In some embodiments, the CD28 ABD includes a variable heavy domain and a variable light domain of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_HIL. In exemplary embodiments, the CD28 antigen binding domain selected from the following CD28 antigen binding domain: CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1.

In another aspect, provided herein is an anti-CD28 antibody that includes a CD28 antigen binding domain (ABD). The CD28 antigen binding domain includes the variable heavy complementary determining regions 1-3 (vhCDR1-3) and the variable light complementary determining regions (vlCDR1-3) of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1. In some embodiments, the CD28 ABD includes a variable heavy domain and a variable light domain of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1. In exemplary embodiments, the CD28 antigen binding domain selected from the following CD28 antigen binding domain: CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1.

In some embodiments, the anti-CD28 antibody includes: a) a first monomer that includes a first antigen binding domain and a first constant domain; and b) a second monomer that includes a second antigen binding domain and a second constant domain, wherein either of the first antigen binding domain or second antigen binding domain is the CD28 antigen binding domain.

In some embodiments, the first antigen binding domain and the second antigen binding domain bind different antigens.

In certain embodiments, the CD28 antigen binding domain is an anti-CD28 single chain fragment (scFv). In exemplary embodiments, the scFv includes a charged scFv linker.

In some embodiments, the first and second constant domains each include CH2-CH3. In exemplary embodiments, the first and second constant domains each are a variant constant domain. In certain embodiments, the first and second constant domains include a set of heterodimerization variants selected from the group consisting of S364K/E357Q: L368D/K370S; S364K: L368D/K370S; S364K: L368E/K370S; D401K: T411E/K360E/Q362E; and T366W: T366S/L368A/Y407V. In certain embodiments, the first and second monomers each further include one or more ablation variants. In exemplary embodiments, the ablation variants are E233P/L234V/L235A/G236del/S267K. In some embodiments, at least one of the first or second monomer further include one or more pI variants. In particular embodiments, the pI variants are N208D/Q295E/N384D/Q418E/N421D.

In another aspect, provided herein is a composition that includes a B7H3 antigen binding domain (ABD). The B7H3 binding domain includes the variable heavy complementary determining regions 1-3 (vhCDR1-3) and the variable light complementary determining regions (vlCDR1-3) of any of the following B7H3 binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In some embodiments, the B7H3 ABD includes a variable heavy domain and a variable light domain of any of the following B7H3 binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In exemplary embodiments, the B7H3 ABD is selected from the following B7H3 antigen binding domain: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In yet another aspect, provided herein is an anti-B7H3 antibody that includes an B7H3 antigen binding domain, the B7H3 antigen binding domain includes the variable heavy complementary determining regions 1-3 (vhCDR1-3) and the variable light complementary determining regions (vlCDR1-3) of any of the following B7H3 antigen binding domain: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In some embodiments, the anti-B7H3 antibody includes a B7H3 antigen binding domain. The B7H3 antigen binding domain includes a variable heavy domain and a variable light domain of any of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704. In exemplary embodiments, the B7H3 antigen binding domain selected from any one of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In some embodiments, the antibody includes: a) a first monomer that includes a first antigen binding domain and a first constant domain; and b) a second monomer that includes a second antigen binding domain and a second constant domain, wherein either of the first antigen binding domain or second antigen binding domain is the B7H3 antigen binding domain. In certain embodiments, first antigen binding domain and the second antigen binding domain bind different antigens.

In exemplary embodiments, the first antigen binding domain is a B7H3 antigen binding domain and the second antigen binding domain is a CD28 binding domain. In some embodiments, the CD28 binding domain includes the vhCDR1-3, and vlCDR1-3 of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_HILL.

In some embodiments, the CD28 binding domain includes the variable heavy domain and variable light domain of any of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_HILL. In certain embodiments, the CD28 binding domain is an anti-CD28 scFv. In exemplary embodiments, the scFv comprises a charged scFv linker.

In some embodiments, the first and second constant domains each comprise CH2-CH3. In exemplary embodiments, the first and second constant domains each are a variant constant domain.

In particular embodiments, the first and second constant domains include a set of heterodimerization variants selected from S364K/E357Q: L368D/K370S; S364K: L368D/K370S; S364K: L368E/K370S; D401K: T411E/K360E/Q362E; and T366W: T366S/L368A/Y407V. In certain embodiments, the first and second monomers each include one or more ablation variants. In certain embodiments, the ablation variants are E233P/L234V/L235A/G236del/S267K. In some embodiments, at least one of the first or second monomers further include one or more pI variants. In particular embodiments, the pI variants are N208D/Q295E/N384D/Q418E/N421D.

In another aspect, provided herein is an anti-CD28 x anti-TAA 1+1 Fab-scFv-Fc heterodimeric antibody. In one embodiment, the heterodimeric antibody includes: a) a first monomer comprising: i) an anti-CD28 scFv comprising a first variable heavy domain, an scFv linker and a first variable light domain; and ii) a first Fc domain, wherein the scFv is covalently attached to the N-terminus of the first Fc domain using a domain linker; b) a second monomer comprising, from N-terminus to C-terminus, a VH2-CH1-hinge-CH2-CH3, wherein VH2 is a second variable heavy domain and CH2-CH3 is a second Fc domain; and c) a third monomer comprising a second variable light domain, wherein the second variable heavy domain and the second variable light domain form a tumor associated antigen (TAA) binding domain.

In some embodiments, the anti-CD28 scFv comprises the vhCDR1-3 and the vlCDR1-3 of any of the following CD28 antigen binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1.

In certain embodiments, the first variable heavy domain and first variable light domain of the anti-CD28 scFv are the variable heavy domain and variable light domain, respectively, of any of the following CD28 antigen binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1.

In particular embodiments, the TAA binding domain is a B7H3 binding domain. In some embodiments, the B7H3 binding domain comprises the vhCDR1-3 and vlCDR1-3 of any of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In exemplary embodiments, the second variable heavy domain and the second variable light domain are the variable heavy domain and variable light domain, respectively, of any of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In exemplary embodiments, the anti-CD28 scFv is oriented, from N-terminus to C-terminus, first variable light domain-scFv linker-first variable heavy domain. In other embodiments, the anti-CD28 scFv is oriented, from N-terminus to C-terminus, first variable heavy domain-scFv linker-first variable light domain. In many embodiments, the scFv linker is a charged scFv linker.

In certain embodiments, first and second Fc domains are variant Fc domains. In some embodiments, the first and second Fc domains comprise a set of heterodimerization skew variants selected from the group consisting of S364K/E357Q: L368D/K370S; S364K L368D/K370S; S364K: L368E/K370S; D401K: T411E/K360E/Q362E; and T366W: T366S/L368A/Y407V, wherein numbering is according to EU numbering. In exemplary embodiments, the first and second Fc domains comprise heterodimerization skew variants S364K/E357Q: L368D/K370S.

In certain embodiments, first and second Fc domains each comprise one or more ablation variants. In exemplary embodiments, the one or more ablation variants are E233P/L234V/L235A/G236del/S267K, wherein numbering is according to EU numbering.

In some embodiments, one of the first or second monomers comprise one or more pI variants. In exemplary embodiments, the CH1-hinge-CH2-CH3 of the second monomer comprises pI variants N208D/Q295E/N384D/Q418E/N421D, wherein numbering is according to EU numbering.

In exemplary embodiments, the first Fc domain comprises amino acid variants S364K/E357Q/E233P/L234V/L235A/G236del/S267K; the CH1-hinge-CH2-CH3 of the second monomer comprises amino acid variants L368D/K370S/N208D/Q295E/N384D/Q418E/N421D/E233P/L234V/L235A/G236del/S267 K, and wherein numbering is according to EU numbering.

In certain embodiments, the scFv linker is a charged scFv linker having the amino acid sequence $(GKPGS)_4$.

In particular embodiments, the first and second Fc domains each further comprise amino acid variants 428/434S.

In some embodiments, the anti-CD28 x anti-TAA 1+1 Fab-scFv-Fc heterodimeric antibody includes: a) a first monomer comprising, from N-terminus to C-terminus, an anti-CD28 scFv-linker-CH2-CH3, wherein CH2-CH3 is a first Fc domain; b) a second monomer comprising, from N-terminus to C-terminus, a VH-CH1-hinge-CH2-CH3, wherein CH2-CH3 is a second variant Fc domain; and c) a third monomer comprising VL-CL; wherein the first variant Fc domain comprises amino acid variants S364K/E357Q, wherein the second variant Fc domain comprises amino acid variants L368D/K370S, wherein the first and second variant Fc domains each comprises amino acid variants E233P/L234V/L235A/G236del/S267K, wherein the CH1-hinge-CH2-CH3 of the second monomer comprises amino acid variants N208D/Q295E/N384D/Q418E/N421D, wherein the VH and VL form a tumor associated antigen (TAA) binding domain, and wherein the anti-CD28 scFv comprises the variable heavy domain and the variable light domain of one of the following CD28 antigen binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1, and wherein numbering is according to EU numbering.

In certain embodiments, the TAA binding domain is a B7H3 binding domain. In some embodiments, VH and VL are the variable heavy domain and variable light domain, respectively, of any of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In exemplary embodiments, the scFv comprises a charged scFv linker having the amino acid sequence $(GKPGS)_4$. In some embodiments, the first and second variant Fc domains each further comprise amino acid variants 428/434S, wherein numbering is according to EU numbering.

In another aspect, provided herein are anti-CD28 x anti-TAA 2+1 $Fab_2$-scFv-Fc antibodies that include: a) a first monomer comprising, from N-terminus to C-terminus, a VH1-CH1-linker 1-anti-CD28 scFv-linker 2-CH2-CH3, wherein VH1 is a first variable heavy domain, linker 1 and linker 2 are a first domain linker and second domain linker, respectively, and CH2-CH3 is a first Fc domain; b) a second monomer comprising, from N-terminus to C-terminus, a VH2-CH1-hinge-CH2-CH3, wherein VH2 is a second variable heavy domain and CH2-CH3 is a second Fc domain; and c) a common light chain comprising a variable light domain; wherein the first variable heavy domain and the variable light domain form a first tumor associated antigen (TAA) binding domain, and the second variable heavy domain and the variable light domain form a second TAA binding domain.

In exemplary embodiments, the first TAA binding domain and second TAA binding domain are each B7H3 binding domains. In exemplary embodiments, the first and second B7H3 binding domains each comprise the vhCDR1-3 and vlCDR1-3 of any of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704. In some embodiments, the first and second variable heavy domain each comprise a variable heavy domain of a B7H3 binding domain, and the variable light domain comprises a variable light domain of the B7H3 binding domain, wherein the B7H3 binding domain is any of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In several embodiments of the anti-CD28 x anti-TAA 2+1 $Fab_2$-scFv-Fc antibody, the anti-CD28 scFv comprises an scFv variable heavy domain, an scFv variable light domain and an scFv linker that connects the scFv variable heavy domain and the scFv variable light domain. In certain embodiments, the anti-CD28 scFv comprises the vhCDR1-3 and the vlCDR1-3 of any of the following CD28 antigen binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1. In certain embodiments, the scFv variable heavy domain and the scFv variable light domain of the anti-CD28 scFv comprises the variable heavy domain and variable light domain, respectively, of any of the following CD28 antigen binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1.

In some embodiments, the scFv variable heavy domain is attached to the C-terminus of the CH1 of the first monomer using the first domain linker and the scFv variable light domain is covalently attached to the N-terminus of the first Fc domain using the second domain linker. In other embodiments, the scFv variable light domain is attached to the C-terminus of the CH1 of the first monomer using the first domain linker and the scFv variable heavy domain is covalently attached to the N-terminus of the first Fc domain using the second domain linker. In some embodiments, the scFv linker is a charged scFv linker.

In certain embodiments, the first and second Fc domains are variant constant domains. In the first and second Fc domains comprise a set of heterodimerization variants selected from the following heterodimerization skew variants: S364K/E357Q L368D/K370S; S364K: L368D/K370S; S364K: L368E/K370S; D401K: T411E/K360E/Q362E; and T366W: T366S/L368A/Y407V, wherein numbering is according to EU numbering. In some embodiments, the first and second Fc domains include heterodimerization skew variants S364K/E357Q: L368D/K370S.

In some embodiments, the first and second Fc domains each include one or more ablation variants. In exemplary embodiments, the one or more ablation variants are E233P/L234V/L235A/G236del/S267K, wherein numbering is according to EU numbering.

In some embodiments, one of the first or second monomer comprises one or more pI variants. In particular embodiments, the CH1-hinge-CH2-CH3 of the second monomer comprises pI variants N208D/Q295E/N384D/Q418E/N421D, wherein numbering is according to EU numbering.

In exemplary embodiments, the first Fc domain of the first monomer comprises amino acid variants S364K/E357Q/E233P/L234V/L235A/G236del/S267K, the CH1-hinge-CH2-CH3 of the second monomer comprises amino acid variants N208D/E233P/L234V/L235A/G236del/S267K/Q295E/L368D/K370S/N384D/Q418E/N421D, and wherein numbering is according to EU numbering.

In some embodiments, the anti-CD28 scFv comprises a charged scFv linker having the amino acid sequence $(GKPGS)_4$. In certain embodiments, the first and second variant Fc domains each further comprise amino acid variants 428/434S, wherein numbering is according to EU numbering.

In some embodiments, the anti-CD28 x anti-TAA 2+1 $Fab_2$-scFv-Fc antibodies include: a) a first monomer comprising from N-terminal to C-terminal, a VH1-CH1-linker 1-anti-CD28 scFv-linker 2-CH2-CH3, wherein CH2-CH3 is a first variant Fc domain; b) a second monomer comprising from N-terminal to C-terminal a VH1-CH1-hinge-CH2—

CH3, wherein CH2-CH3 is a second variant Fc domain; and c) a common light chain comprising VL-CL; wherein the first variant Fc domain comprises amino acid variants S364K/E357Q, wherein the second variant Fc domain comprises amino acid variants L368D/K370S, wherein the first and second variant Fc domains each comprises amino acid variants E233P/L234V/L235A/G236del/S267K, wherein the CH1-hinge-CH2-CH3 of the second monomer comprises amino acid variants N208D/Q295E/N384D/Q418E/N421D, wherein the VH1 and VL each form a tumor associated antigen (TAA) binding domain, wherein the anti-CD28 scFv comprises the variable heavy domain and the variable light domain of any of the following CD28 antigen binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1, and wherein numbering is according to EU numbering.

In some embodiments, the VH1 and VL form a B7H3 binding domain. In exemplary embodiments, the VH1 and VL are the variable heavy domain and variable light domain of any of the following B7H3 antigen binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In some embodiments, the scFv comprises a charged scFv linker having the amino acid sequence $(GKPGS)_4$. In certain embodiments, the first and second variant Fc domains each further comprise amino acid variants 428/434S.

In another aspect, provided herein are anti-CD28 x anti-TAA 1+1 CLC heterodimeric antibodies that include: a) a first monomer comprising, from N-terminus to C-terminus, a VH1-CH1-hinge-CH2-CH3, wherein VH1 is a first variable heavy domain and CH2-CH3 is a first Fc domain; b) a second monomer comprising, from N-terminus to C-terminus, a VH2-CH1-hinge-CH2-CH3, wherein VH2 is a second variable heavy domain and CH2-C3 is a second Fc domain; and c) a common light chain comprising, from N-terminus to C-terminus, VL-CL, wherein VL is a variable light domain and CL is a constant light domain, wherein the first variable heavy domain and the variable light domain form a first antigen binding domain, and the second variable heavy domain and the variable light domain form a second antigen binding domain.

In some embodiments, the first Fc domain and second Fc domain are each variant Fc domains. In certain embodiments, the first and second Fc domains comprise a set of heterodimerization skew variants selected from the following heterodimerization variants: S364K/E357Q: L368D/K370S; S364K: L368D/K370S; S364K: L368E/K370S; D401K: T411E/K360E/Q362E; and T366W: T366S/L368A/Y407V, wherein numbering is according to EU numbering.

In exemplary embodiments, the first and second Fc domains comprise heterodimerization skew variants S364K/E357Q: L368D/K370S.

In certain embodiments, the first and second Fc domains each comprise one or more ablation variants. In exemplary embodiments, the one or more ablation variants are E233P/L234V/L235A/G236del/S267K, wherein numbering is according to EU numbering.

In some embodiments, one of the first or second monomer further comprises a pI variant. In particular embodiments, the CH1-hinge-CH2-CH3 of the first monomer comprises pI variants N208D/Q295E/N384D/Q418E/N421D, wherein numbering is according to EU numbering.

In certain embodiments, the CH1-hinge-CH2-CH3 of the first monomer comprises amino acid variants L368D/K370S/N208D/Q295E/N384D/Q418E/N421D/E233P/L234V/L235A/G236del/S267 K, the second Fc domain comprises amino acid variants S364K/E357Q/E233P/L234V/L235A/G236de1/S267K, and wherein numbering is according to EU numbering.

In some embodiments, the first and second variant Fc domains each comprise amino acid variants 428/434S.

In certain embodiments, the first antigen binding domain or the second binding domain binds CD28 and the other antigen binding domain binds a tumor associated antigen (TAA).

In certain embodiments, the second antigen binding domain binds CD28 and VH2 and VL comprises the variable heavy domain and variable light domain, respectively, of any one of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_HILL In some embodiments, the first antigen binding domain binds the TTA. IN exemplary embodiments, the TAA is B7H3. In exemplary embodiments, the VH1 and VL comprises the variable heavy domain and variable light domain, respectively, of any one of the following B7H3 binding domains: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In exemplary embodiments, the first antigen binding domain binds B7H3 and the second antigen binding domain binds CD28, VH1 is variable heavy domain 2E4A3.189[B7H3]_H1.22, VH2 is variable heavy domain 1A7[CD28]_H1.14, and VL is variable light domain 1A7[CD28]_L1.

In one aspect, provided herein are anti-CD28 x anti-TAA 2+1 CLC heterodimeric antibodies that include: a) a first monomer comprising, from N-terminus to C-terminus, a VH1-CH1-linker-VH1-CH1-hinge-CH2-CH3, wherein the VH1s are each a first variable heavy domain and CH2-CH3 is a first Fc domain; b) a second monomer comprising, from N-terminus to C-terminus, a VH2-CH1-hinge-CH2-CH3, wherein VH2 is a second variable heavy domain and CH2-

C3 is a second Fc domain; and c) a common light chain comprising, from N-terminus to C-terminus, VL-CL, wherein VL is a variable light domain and CL is a constant light domain, wherein the first variable heavy domains and the variable light domain each form a first antigen binding domain, and the second variable heavy domain and the variable light domain form a second antigen binding domain.

In some embodiments, the first Fc domain and second Fc domain are each variant Fc domains. In some embodiments, the first and second Fc domains comprise a set of heterodimerization skew variants selected from the following heterodimerization variants: S364K/E357Q: L368D/K370S; S364K: L368D/K370S; S364K: L368E/K370S; D401K: T411E/K360E/Q362E; and T366W: T366S/L368A/Y407V, wherein numbering is according to EU numbering. In certain embodiments, the first and second Fc domains comprise heterodimerization skew variants S364K/E357Q: L368D/K370S.

In several embodiments, the first and second Fc domains each comprise one or more ablation variants. In exemplary embodiments, the one or more ablation variants are E233P/L234V/L235A/G236del/S267K, wherein numbering is according to EU numbering.

In particular embodiments, the one of the first or second monomer further comprises a pI variant. In exemplary embodiments, the CH1-hinge-CH2-CH3 of the first monomer comprises pI variants N208D/Q295E/N384D/Q418E/N421D, wherein numbering is according to EU numbering.

In some embodiments of the anti-CD28 x anti-TAA 2+1 CLC heterodimeric antibodies, the CH1-hinge-CH2-CH3 of the first monomer comprises amino acid variants L368D/K370S/N208D/Q295E/N384D/Q418E/N421D/E233P/L234V/L235A/G236del/S267 K, the second Fc domain comprises amino acid variants S364K/E357Q/E233P/L234V/L235A/G236del/S267K, and wherein numbering is according to EU numbering.

In some embodiments, the first and second variant Fc domains each comprise amino acid variants 428/434S.

In certain embodiments, the first antigen binding domains binds CD28 and the second antigen binding domain binds a tumor associated antigen (TAA). In exemplary embodiments, VH1 and VL comprises the variable heavy domain and variable light domain, respectively, of any one of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1.

In some embodiments, the TAA is B7H3. In exemplary embodiments, VH2 and VL comprises the variable heavy domain and variable light domain, respectively, of any one of the following B7H3 binding domains: 2E4A3.189[B7H3]_ H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704.

In some embodiments, VH1 is variable heavy domain 1A7[CD28]_H1.14, VH2 is variable heavy domain 2E4A3.189[B7H3]_H1.22, and VL is variable light domain 1A7[CD28]_L1.

In another aspect, provided herein is a heterodimeric antibody selected from the following heterodimeric antibodies: XENP34730, XENP34389, XENP34728, XENP34717 and XENP34339.

Also provided herein are nucleic acid compositions encoding the compositions and antibodies provided herein, expression vectors that include such nucleic acids, and host cells that include the expression vectors.

In another aspect, provided herein are methods of treating a cancer comprising administering to a patient in need thereof an antibody provided herein (e.g., an anti-CD28 x anti-TAA antibody). In some embodiments, the patient is also administered a cancer therapeutic. In particular embodiments, the therapeutic is a checkpoint inhibitor (e.g., an anti-PD1 antibody) or an anti-CD3 x anti-TAA bispecific antibody.

BRIEF DESCRIPTION OF THE DRAWINGS

FIG. 1 depicts the sequences for human, mouse, and cynomolgus CD28. Such CD28 are useful for the development of cross-reactive CD28 antigen binding domains for ease of clinical development.

FIGS. 2A and 2B depict the sequences for human, mouse, and cynomolgus B7H3. Such B7H3 are useful for the development of cross-reactive B7H3 antigen binding domains for ease of clinical development.

FIG. 3A-3F depict useful pairs of heterodimerization variant sets (including skew and pI variants). In FIG. 3F, there are variants for which there are no corresponding "monomer 2" variants. Such variants are pI variants that can be used alone on either monomer of a αB37H3 x αCD28 bsAb, or included, for example, on the non-scFv side of a format that utilizes an scFv as a component and an appropriate charged scFv linker can be used on the second monomer that utilizes an scFv as the CD28 binding domain. Suitable charged linkers are shown in FIG. 6.

FIG. 4 depicts a list of isosteric variant antibody constant regions and their respective substitutions. pI_(−) indicates lower pI variants, while pI_(+) indicates higher pI variants. These variants can be optionally and independently combined with other variants, including heterodimerization variants, outlined herein.

FIG. 5 depict useful ablation variants that ablate FcγR binding (also referred to as "knockouts" or "KO" variants). In some embodiments, such ablation variants are included in the Fc domain of both monomers of the subject antibody described herein. In other embodiments, the ablation variants are only included on only one variant Fc domain.

FIG. 6 depicts a number of charged scFv linkers that find use in increasing or decreasing the pI of the subject heterodimeric αB7H3 x αCD28 bsAbs that utilize one or more scFv as a component, as described herein. The (+H) positive linker finds particular use herein, particularly with anti-CD28 $V_L$ and $V_H$ sequences shown herein. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs. Such charged scFv linkers can be used in any of the subject antibody formats disclosed herein that include scFvs (e.g., 1+1 Fab-scFv-Fc and 2+1 $Fab_2$-scFv-Fc formats).

FIG. 7 depicts a number of exemplary domain linkers. In some embodiments, these linkers find use linking a single-chain Fv to an Fc chain. In some embodiments, these linkers may be combined in any orientation. For example, a GGGGS linker may be combined with a "lower half hinge" linker at the N-terminus or at the C-terminus. In some embodiments, two or more of the domain linkers depicted in FIG. 7 can be combined to form longer domain linkers for use in the heterodimeric antibodies described herein.

FIG. 8 shows a particularly useful embodiment of the heterodimeric Fc domains (i.e. CH2-CH3 in this embodiment) of the αB7H3 x αCD28 bsAbs of the invention.

FIG. 9 depicts various heterodimeric skewing variant amino acid substitutions that can be used with the heterodimeric antibodies described herein.

FIGS. 10A-10C show the sequences of several useful heterodimeric αB7-H3 xαCD28 bsAb backbones based on human IgG1, without the cytokine sequences. Heterodimeric Fc backbone 1 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants on both chains. Heterodimeric Fc backbone 2 is based on human IgG1 (356E/358M allotype), and includes the L368D/K370S skew variants and the Q295E/N384D/Q418E/N421D pI variants on a first heterodimeric Fc chain, the S364K skew variant on a second heterodimeric Fc chain, and the E233P/L234V/L235A/G236del/S267K ablation variants on both chains. Heterodimeric Fc backbone 3 is based on human IgG1 (356E/358M allotype), and includes the L368E/K370S skew variants and the Q295E/N384D/Q418E/N421D pI variants on a first heterodimeric Fc chain, the S364K skew variant on a second heterodimeric Fc chain, and the E233P/L234V/L235A/G236del/S267K ablation variants on both chains. Heterodimeric Fc backbone 4 is based on human IgG1 (356E/358M allotype), and includes the K360E/Q362E/T411E skew variants and the Q295E/N384D/Q418E/N421D pI variants on a first heterodimeric Fc chain, the D401K skew variant on a second heterodimeric Fc chain, and the E233P/L234V/L235A/G236del/S267K ablation variants on both chains. Heterodimeric Fc backbone 5 is based on human IgG1 (356D/358L allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236de1/S267K ablation variants on both chains. Heterodimeric Fc backbone 6 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and N297A variant that removes glycosylation on both chains. Heterodimeric Fc backbone 7 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and N297S variant that removes glycosylation on both chains. Heterodimeric Fc backbone 8 is based on human IgG4, and includes the L368D/K370S skew variants and the Q295E/N384D/Q418E/N421D pI variants on a first heterodimeric Fc chain, the S364K/E357Q skew variants on a second heterodimeric Fc chain, and the S228P (according to EU numbering, S241P in Kabat) variant that ablates Fab arm exchange (as is known in the art) on both chains. Heterodimeric Fc backbone 9 is based on human IgG2, and includes the L368D/K370S skew variants and the Q295E/N384D/Q418E/N421D pI variants on a first heterodimeric Fc chain, the S364K/E357Q skew variants on a second heterodimeric Fc chain. Heterodimeric Fc backbone 10 is based on human IgG2, and includes the L368D/K370S skew variants and the Q295E/N384D/Q418E/N421D pI variants on a first heterodimeric Fc chain, the S364K/E357Q skew variants on a second heterodimeric Fc chain, and the S267K ablation variant on both chains. Heterodimeric Fc backbone 11 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and M428L/N434S Xtend variants on both chains. Heterodimeric Fc backbone 12 is based on human IgG1 (356E/358M allotype), and includes the L368D/K370S skew variants on a first heterodimeric Fc chain, the S364K/E357Q skew variants and P217R/P229R/N276K pI variants on a second heterodimeric Fc chain, and the E233P/L234V/L235A/G236del/S267K ablation variants on both chains.

Figure 25:
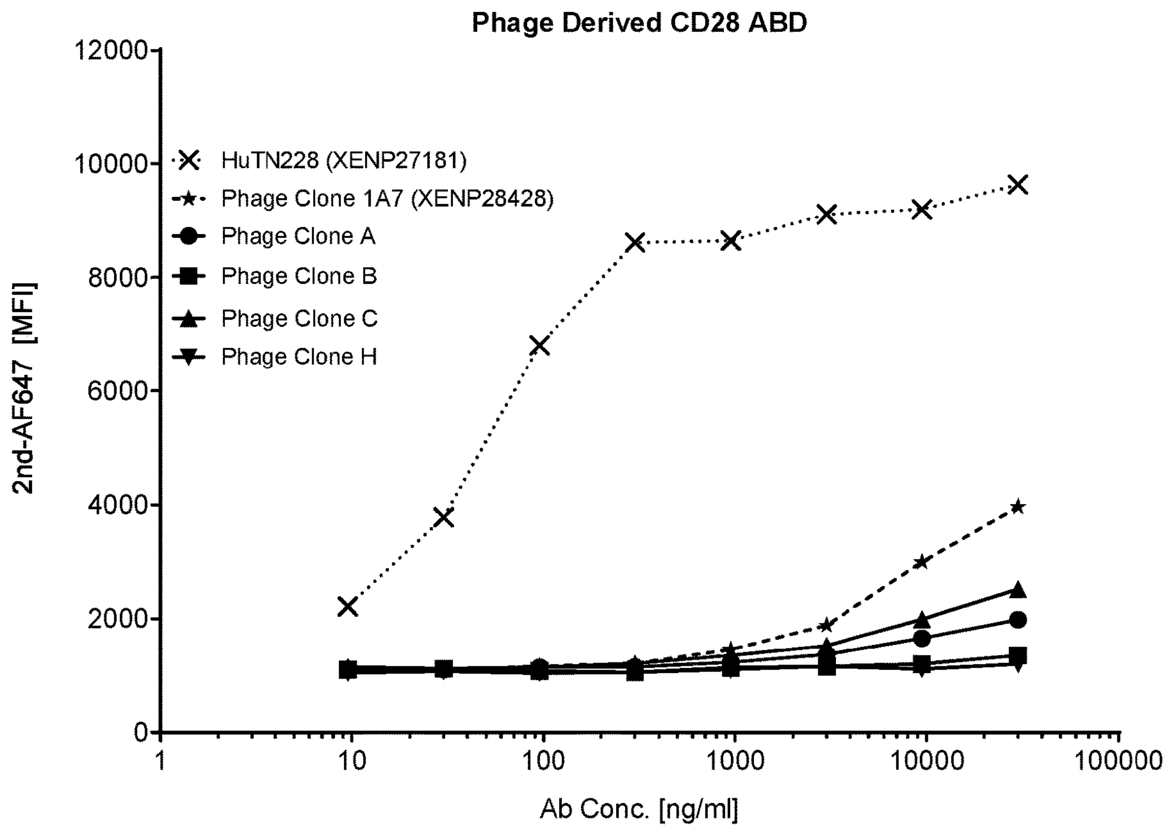

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition or as an alternative to the skew, pI and ablation variants contained within the backbones of this Figure. Additionally, the backbones depicted herein may include deletion of the C-terminal glycine (K446_) and/or lysine (K447_). The C-terminal glycine and/or lysine deletion may be intentionally engineered to reduce heterogeneity or in the context of certain bispecific formats, such as the mAb-scFv format. Additionally, C-terminal glycine and/or lysine deletion may occur naturally for example during production and storage.

FIG. 11 depicts illustrative sequences of heterodimeric B7H3 x CD28 bsAb backbone for use in the 2+1 mAb-scFv format. The format depicted here is based on heterodimeric Fc backbone 1 as depicted in Figure X, except further including G446_on monomer 1 (−) and G446_/K447_on monomer 2 (+). It should be noted that any of the additional backbones depicted in Figure X may be adapted for use in the 2+1 mAb-scFv format with or without including K447_on one or both chains. It should be noted that these sequences may further include the M428L/N434S variants.

FIG. 12 depicts sequences for "CH1+hinge" that find use in embodiments of αB7H3 x αCD28 bsAbs that utilize a Fab a binding domain. The "CH1+hinge" sequences find use linking the variable heavy domain ($V_H$) to the Fc backbones (as depicted in FIG. 39). For particular embodiments wherein the Fab is on the (+) side, the "CH1(+)+hinge" sequences may find use. For particular embodiments wherein the Fab is on the (−) side, the "CH1(−)+hinge" sequences may find use.

FIG. 13 depicts sequences for "CH1+half hinge" domain linker that find use in embodiments of αB7H3 x αCD28 bsAbs in the 2+1 $Fab_2$-scFv-Fc format or 2+1 CLC format. In the 2+1 $Fab_2$-scFv-Fc format, the "CH1+half hinge" sequences find use linking the variable heavy domain ($V_H$) to the scFv domain on the Fab-scFv-Fc side of the bispecific antibody. In the 2+1 CLC format, the "CH1+half hinge" sequences find use linking the first variable heavy domain ($V_H$) to the second $V_H$ domain on the Fab-Fab-Fc side of the bispecific antibody. It should be noted that other linkers may be used in place of the "CH1+half hinge". It should also be noted that although the sequences here are based on the IgG1 sequence, equivalents can be constructed based on the IgG2 or IgG4 sequences.

FIG. 14 depicts sequences for "CH1" that find use in embodiments of αB7H3 x αCD28 bsAbs.

Figure 15:
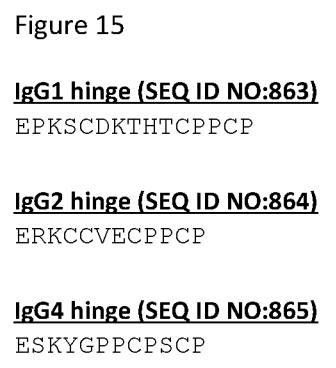

FIG. 15 depicts sequences for "hinge" that find use in embodiments of αB7H3 x αCD28 bsAbs.

FIG. 16 depicts the constant domain of the cognate light chains which find use in the subject αB7H3 x αCD28 bsAbs that utilize a Fab binding domain.

FIG. 17 depicts the sequences for XENP16432, an anti-PD-1 mAb based on nivolumab and and IgG1 backbone with E233P/L234V/L235A/G236del/S267K ablation variant. CDRs are underlined and slashes indicate the border(s) between the variable regions and constant domain.

FIG. 18 depicts the variable heavy and variable light chain sequences for 1A7, an exemplary phage-derived CD28 binding domain, as well as the sequences for XENP28428, an anti-CD28 mAb based on 1A7 and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 19 depicts the sequence for illustrative affinity-optimized 1A7 VH variants. It should be noted that the VH depicted herein can be paired with any of the other variable light domains depicted herein.

FIG. 20 depicts the sequence for illustrative affinity-optimized 1A7-derived variable light domains. It should be noted that this VL can be paired with any of the other variable heavy domains depicted herein.

FIGS. 21A and 21B depict the sequence for illustrative affinity-optimized 1A7 VH/VH pairs. It should be noted that these pairs may be formatted as Fabs or as scFvs.

FIG. 22 depicts illustrative affinity-engineered 1A7 VH/VL pairs and their binding affinities in the context of A) scFvs (in the context of 1+1 Fab-scFv-Fc bsAb format) and B) Fab (in the context of 2+1 CLC bsAb format).

FIG. 23 depicts the sequences for XENP27181, a bivalent anti-CD28 mAb based on HuTN228 binding domain and IgG1 backbone with E233P/L234V/L235A/G236del/S267K ablation variant; and XENP27656, a monovalent anti-CD28 mAb based on HuTN228 binding domain (formatted as an scFv) and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 24 depicts $K_{Dapp}$ ($K_D$ apparent due to bivalent binding) of various CD28 binding phage clones (formatted as bivalent mAbs) for human CD28 as determined by Octet. First 60 seconds of dissociation was used for data fit.

FIG. 25 depicts binding of illustrative bivalent anti-CD28 mAbs based on phage-derived clones on human PBMCs. The data show that the phage campaign generated CD28 binding domains having weaker maximum binding than prior art HuTN228 (which is related to the humanized CD28 binding domains described in Example 1A).

FIG. 26 depicts the variable heavy and variable light chain sequences for 2E4A3.189, an exemplary phage-derived B7H3 binding domain, as well as the sequences for XENP32637, an anti-B7H3 mAb based on 2E4A3.189 and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 27 depicts the sequence for affinity-optimized variable heavy 2E4A3.189_H1.22. It should be noted that this VH can be paired with any of the other variable light domains (VL) depicted herein.

FIG. 28 depicts the variable heavy and variable light chain sequences for humanized 6A1, an exemplary rat hybridoma-derived B7H3 binding domain, as well as the sequences for XENP33383, an anti-B7H3 mAb based on 6A1 and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 29 depicts the variable heavy and variable light chain sequences for humanized 3C4, an exemplary rat hybridoma-derived B7H3 binding domain. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 30 depicts the variable heavy and variable light chain sequences for humanized 4F12, an exemplary rabbit hybridoma-derived B7H3 binding domain. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 31 depicts the variable heavy and variable light chain sequences for humanized 38E2, an exemplary rabbit hybridoma-derived B7H3 binding domain. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 32 depicts the monovalent binding affinities ($K_D$) of various B7H3 binding domains in the context of 1+1 bispecific formats. It should be noted that the 2E4A3_H1.22_1A7_L1 and 2E4A3_H1.3_1A7_L1 utilize the VL of anti-CD28 clone 1A7.

FIGS. 33A-33E depict exemplary formats of the present invention. FIG. 33A depicts the "1+1 Fab-scFv-Fc" format, with a first Fab arm binding a first antigen and a second scFv arm binding second antigen. The 1+1 Fab-scFv-Fc format comprises a first monomer comprising a first heavy chain variable region (VH1) covalently attached to the N-terminus of a first heterodimeric Fc backbone (optionally via a linker), a second monomer comprising a single-chain Fv covalently attached to the N-terminus of a second corresponding heterodimeric Fc backbone (optionally via a linker), and a third monomer comprising a light chain variable region covalently to a light chain constant domain, wherein the light chain variable region is complementary to the VH1. FIG. 33B depicts the "2+1 $Fab_2$-scFv-Fc" format, with a first Fab arm and a second Fab-scFv arm, wherein the Fab binds a first antigen and the scFv binds second antigen. The 2+1 $Fab_2$-scFv-Fc format comprises a first monomer comprising a first heavy chain variable region (VH1) covalently attached to the N-terminus of a first heterodimeric Fc backbone (optionally via a linker), a second monomer comprising the VH1 covalently attached (optionally via a linker) to a single-chain Fv covalently attached (optionally via a linker) to the N-terminus of a second corresponding heterodimeric Fc backbone, and a third monomer comprising a light chain variable region covalently to a light chain constant domain, wherein the light chain variable region is complementary to the VH1. FIG. 33C depicts the "1+1 Common Light Chain" or "1+1 CLC" format, with a first Fc comprising a first Fab arm binding a first antigen and a second Fc comprising a second Fab arm binding second antigen. The 1+1 CLC format comprises a first monomer comprising VH1-CH1-hinge-CH2-CH3, a second monomer comprising VH2-CH1-hinge-CH2-CH3, and a third monomer comprising VL-CL. The VL pairs with the VH1 to form a binding domain with a first antigen binding specificity; and the VL pairs with the VH2 to form a binding domain with a second antigen binding specificity.

FIG. 33D depicts the "2+1 Common Light Chain" or "2+1 CLC" format, with a first Fc comprising 2 Fab arms each binding a first antigen and a second Fc comprising 1 Fab arm binding a second antigen. The 2+1 CLC format comprises a first monomer comprising VH1-CH1-hinge-VH1-CH1-hinge-CH2-CH3, a second monomer comprising VH2-CH1-hinge-CH2-CH3, and a third monomer comprising VL-CL. The VL pairs with the first and second VH1 to form binding domains with a first antigen binding specificity; and the VL pairs with the VH2 to form a binding domain with a second antigen binding specificity.

FIG. 33E depicts the "2+1 mAb-scFv" format, with a first Fc comprising an N-terminal Fab arm binding a first antigen and a second Fc comprising an N-terminal Fab arm binding the first antigen and a C-terminal scFv binding a second antigen. The 2+1 mAb-scFv format comprises a first monomer comprising VH1-CH1-hinge-CH2-CH3, a second monomer comprising VH1-CH1-hinge-CH2-CH3-scFv, and a third monomer comprising VL-CL. The VL pairs with the first and second VH1 to form binding domains with binding specificity for the first antigen.

FIGS. 34A-34E depict exemplary formats of the present invention as utilized in CD28 bispecific antibodies. FIG. 34A depicts the "1+1 Fab-scFv-Fc" format, with a first Fab arm binding a tumor-associated antigen and a second scFv arm binding CD28. The 1+1 Fab-scFv-Fc format comprises a first monomer comprising a first heavy chain variable region (VH1) covalently attached to the N-terminus of a first heterodimeric Fc backbone (optionally via a linker), a second monomer comprising a single-chain Fv covalently attached to the N-terminus of a second corresponding heterodimeric Fc backbone (optionally via a linker), and a third monomer comprising a light chain variable region covalently to a light chain constant domain, wherein the light chain variable region is complementary to the VH1. FIG. 34B depicts the "2+1 $Fab_2$-scFv-Fc" format, with a first Fab arm and a second Fab-scFv arm, wherein the Fab binds a tumor-associated antigen and the scFv binds CD28. The 2+1 $Fab_2$-scFv-Fc format comprises a first monomer comprising a first heavy chain variable region (VH1) covalently attached to the N-terminus of a first heterodimeric Fc backbone (optionally via a linker), a second monomer comprising the VH1 covalently attached (optionally via a linker) to a single-chain Fv covalently attached (optionally via a linker) to the N-terminus of a second corresponding heterodimeric Fc backbone, and a third monomer comprising a light chain variable region covalently to a light chain constant domain, wherein the light chain variable region is complementary to the VH1. FIG. 34C depicts the "1+1 Common Light Chain" or "1+1 CLC" format, with a first Fc comprising a first Fab arm binding a tumor-associated antigen and a second Fc comprising a second Fab arm binding CD28. The 1+1 CLC format comprises a first monomer comprising VH1-CH1-hinge-CH2-CH3, a second monomer comprising VH2-CH1-hinge-CH2-CH3, and a third monomer comprising VL-CL. The VL pairs with the VH1 to form a binding domain with a first antigen binding specificity; and the VL pairs with the VH2 to form a binding domain with a second antigen binding specificity. FIG. 34D depicts the "2+1 Common Light Chain" or "2+1 CLC" format, with a first Fc comprising 2 Fab arms each binding a tumor-associated antigen and a second Fc comprising 1 Fab arm binding CD28. The 2+1 CLC format comprises a first monomer comprising VH1-CH1-hinge-VH1-CH1-hinge-CH2-CH3, a second monomer comprising VH2-CH1- hinge-CH2-CH3, and a third monomer comprising VL-CL. The VL pairs with the first and second VH1 to form binding domains with a first antigen binding specificity; and the VL pairs with the VH2 to form a binding domain with a second antigen binding specificity. FIG. 34E depicts the "2+1 mAb-scFv" format, with a first Fc comprising an N-terminal Fab arm binding a tumor-associated antigen and a second Fc comprising an N-terminal Fab arm binding a tumor-associated antigen and a C-terminal scFv binding CD28. The 2+1 mAb-scFv format comprises a first monomer comprising VH1-CH1-hinge-CH2-CH3, a second monomer comprising VH1-CH1-hinge-CH2-CH3-scFv, and a third monomer comprising VL-CL. The VL pairs with the first and second VH1 to form binding domains with binding specificity for the tumor-associated antigen.

FIGS. 35A and 35B depict the sequences for illustrative αB7H3 x αCD28 bsAbs in the 1+1 Fab-scFv-Fc format. CDRs are underlined and slashes indicate the border(s) between the variable regions, linkers, Fc regions, and constant domains. It should be noted that the αB7H3 x αCD28 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIG. 36A-36C depict the sequences for illustrative αB7H3 x αCD28 bsAbs in the 2+1 $Fab_2$-scFv-Fc format. CDRs are underlined and slashes indicate the border(s) between the variable regions, linkers, Fc regions, and constant domains. The scFv domain has orientation (N- to C-terminus) of $V_H$-scFv linker-$V_L$, although this can be reversed. It should be noted that the scFv domain sequences includes as the scFv linker between the variable heavy and variable light region the sequence GKPGSGKPGSGKPGSGKPGS (SEQ ID NO:796); however, this linker can be replaced with any of the scFv linkers in FIG. 6. It should also be noted that the Chain 2 sequences include as the domain linker between the C-terminus of the scFv and the N-terminus of the CH2 domain the sequence GGGGSGGGGSKTHTCPPCP (SEQ ID NO:818), which is a "flex half hinge" domain linker; however, this linker can be replaced with any of the "useful domain linkers" of FIG. 7. It should be noted that the αB37H3 x αCD28 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIG. 37 depicts the sequences for illustrative αB7H3 x αCD28 bsAbs in the 1+1 CLC format. CDRs are underlined and slashes indicate the border(s) between the variable regions, linkers, Fc regions, and constant domains. It should be noted that the αB7H3 x αCD28 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIGS. 38A-38E depicts the sequences for illustrative αB7H3 x αCD28 bsAbs in the 2+1 CLC format. CDRs are underlined and slashes indicate the border(s) between the variable regions, linkers, Fc regions, and constant domains. The scFv domain has orientation (N- to C-terminus) of VH-scFv linker-$V_L$, although this can be reversed. It should be noted that the Chain 2 sequences include as a domain linker (double underlined) the sequence EPKSCGKPGSGKPGS (SEQ ID NO: 1182); however, this linker can be replaced with any domain linker include any of the "useful domain linkers" of FIG. 6. It should be noted that the αB37H3 x αCD28 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIGS. 39A-39E depict the sequences for illustrative αB7H3 x αCD28 bsAbs in the 2+1 mAb-scFv format. CDRs are underlined and slashes indicate the border(s) between the variable regions, linkers, Fc regions, and constant domains. The scFv domain has orientation (N- to C-terminus) of $V_H$-scFv linker-$V_L$, although this can be reversed. It should be noted that the Chain 2 sequences include as a domain linker the sequence GKPGSGKPGSGKPGSGKPGS (SEQ ID NO:796); however, this linker can be replaced with any domain linker include any of the "useful domain linkers" of FIG. 6. It should be noted that the αB37H3 x αCD28 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

Figure 40A:
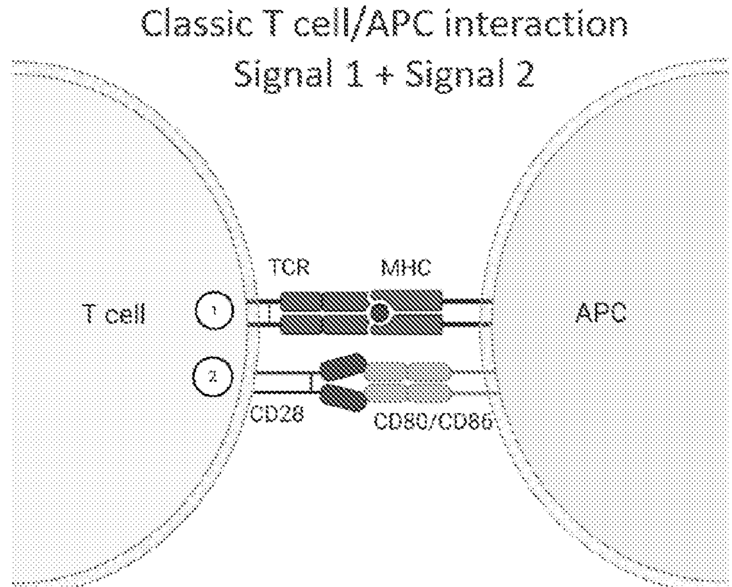
Figure 40B:
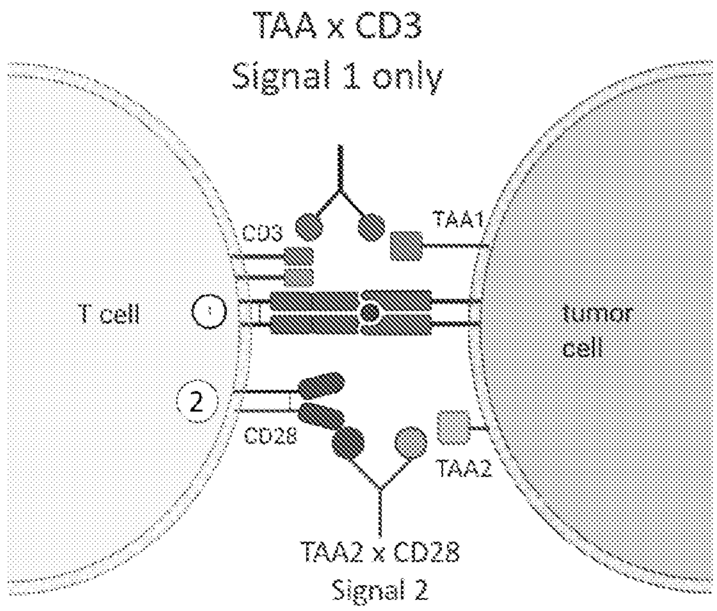

FIGS. 40A and 40B depict A) classic T cell/APC interaction and B) replication of the classic T cell/APC interaction by combining CD3 bispecific antibodies with CD28 bispecific antibodies. In classic T cell/APC interaction, there is a first signal provided by TCR reactivity with peptide-MHC (Signal 1) and a second signal provided by CD28 crosslinking by CD80/CD86 being expressed on APCs (Signal 2) which together fully activate T cells. In contrast in treatment with CD3 bispecifics, only the first signal is provided. The CD28 signal may be provided by a CD28 bispecific with the idea to promote activation and proliferation through CD28 costimulation.

Figure 41:
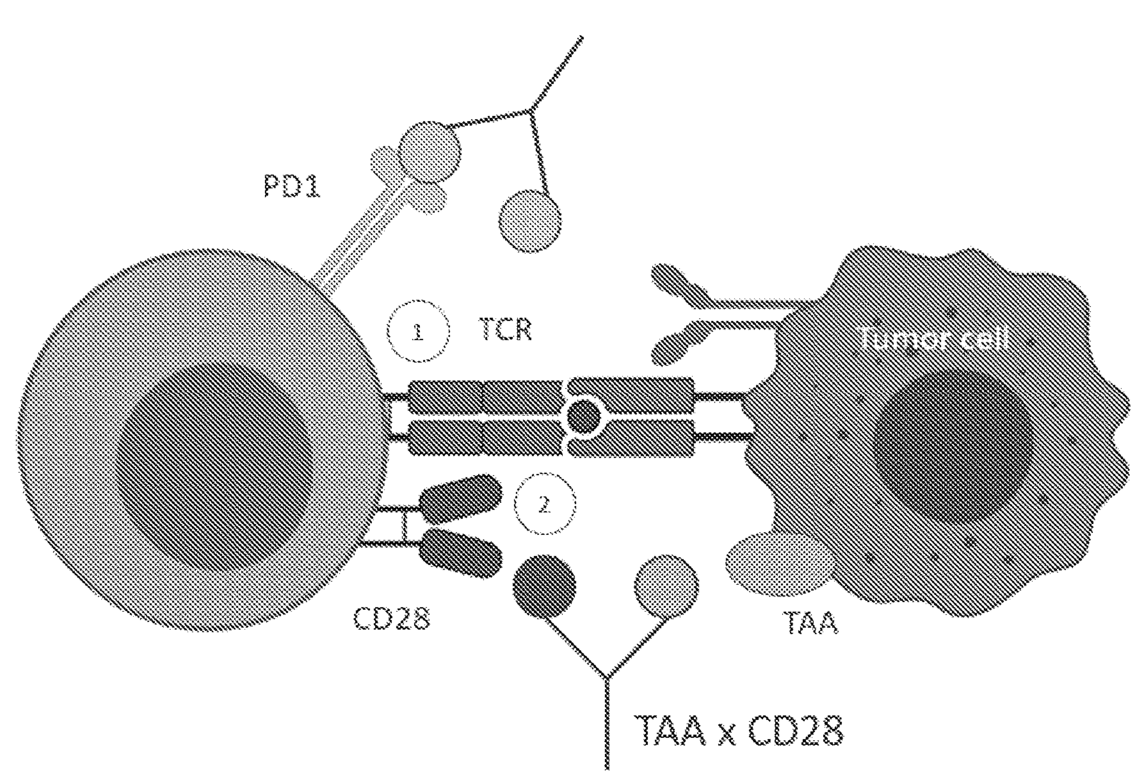

FIG. 41 depicts the introduction of CD28 signaling by a CD28 bispecific antibody and mitigation of any checkpoint mediated repression of the added CD28 signal by checkpoint blockade (e.g. PD-1 blockade).

Figure 42:
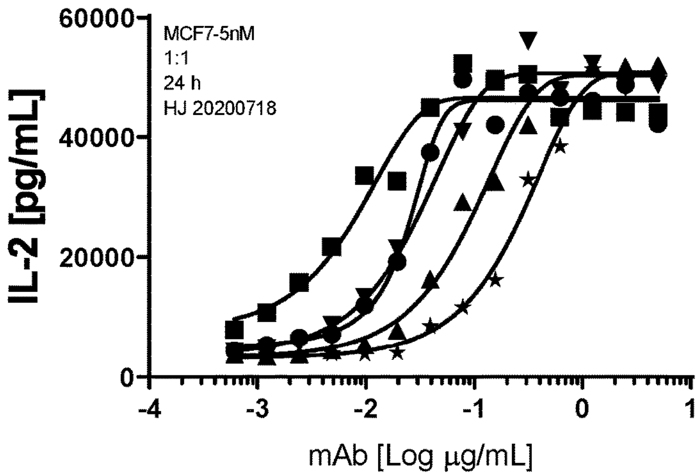

FIG. 42 depicts induction of IL-2 release by effector cells in the presence of MCF7 cancer cells transfected with anti-CD3 scFv (1:1 effector:target ratio) and B7H3 x CD3 bsAbs XENP34339, XENP35612, XENP35611, and XENP34336 (respectively having CD28 binding affinities of 77 nM, 270 nM, 610 nM, and 440 nM). The data show that reducing CD28 binding affinity reduces potency of the B7H3 x CD28 bispecific antibodies.

Figure 43A:
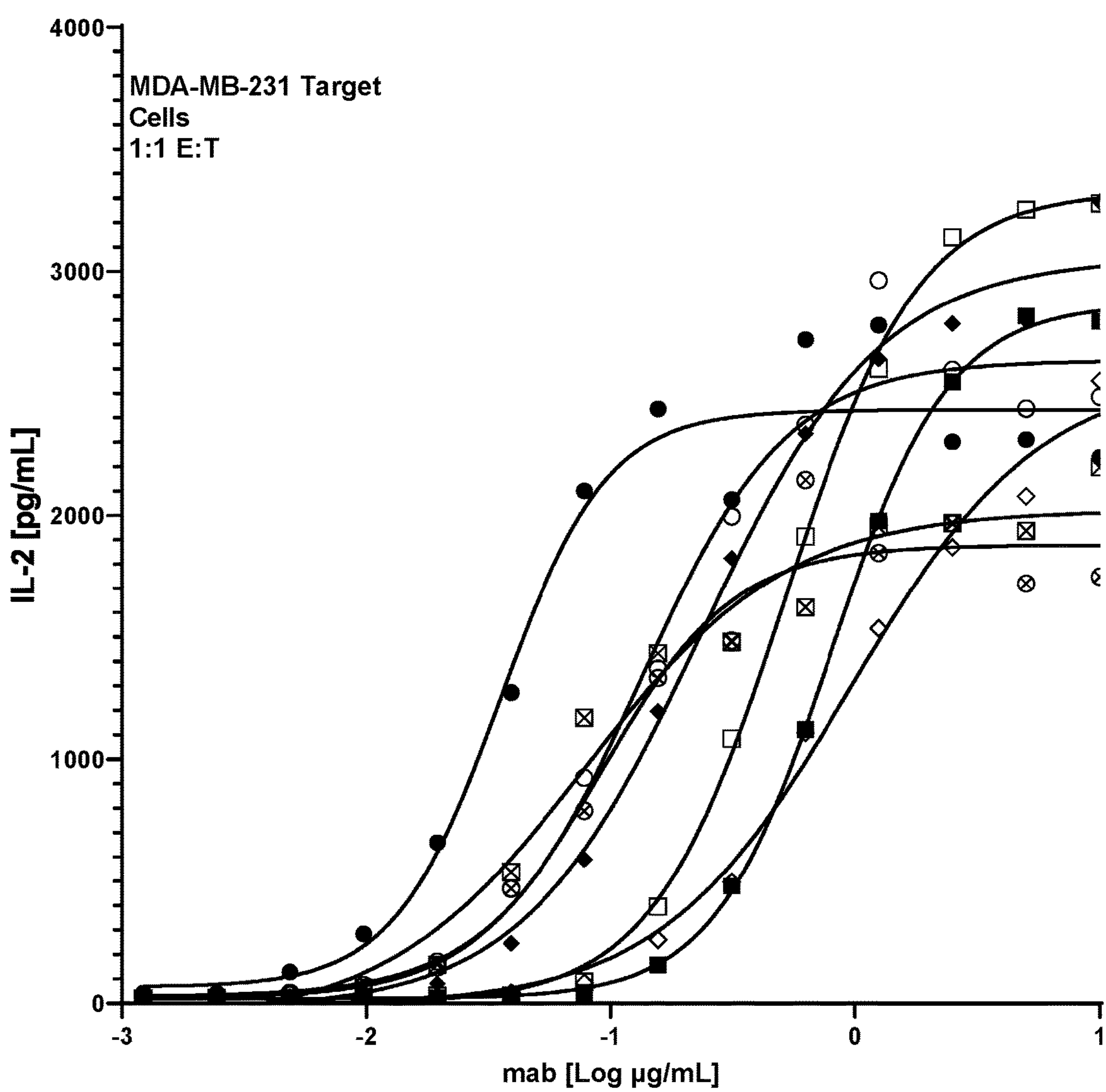
Figure 43B:
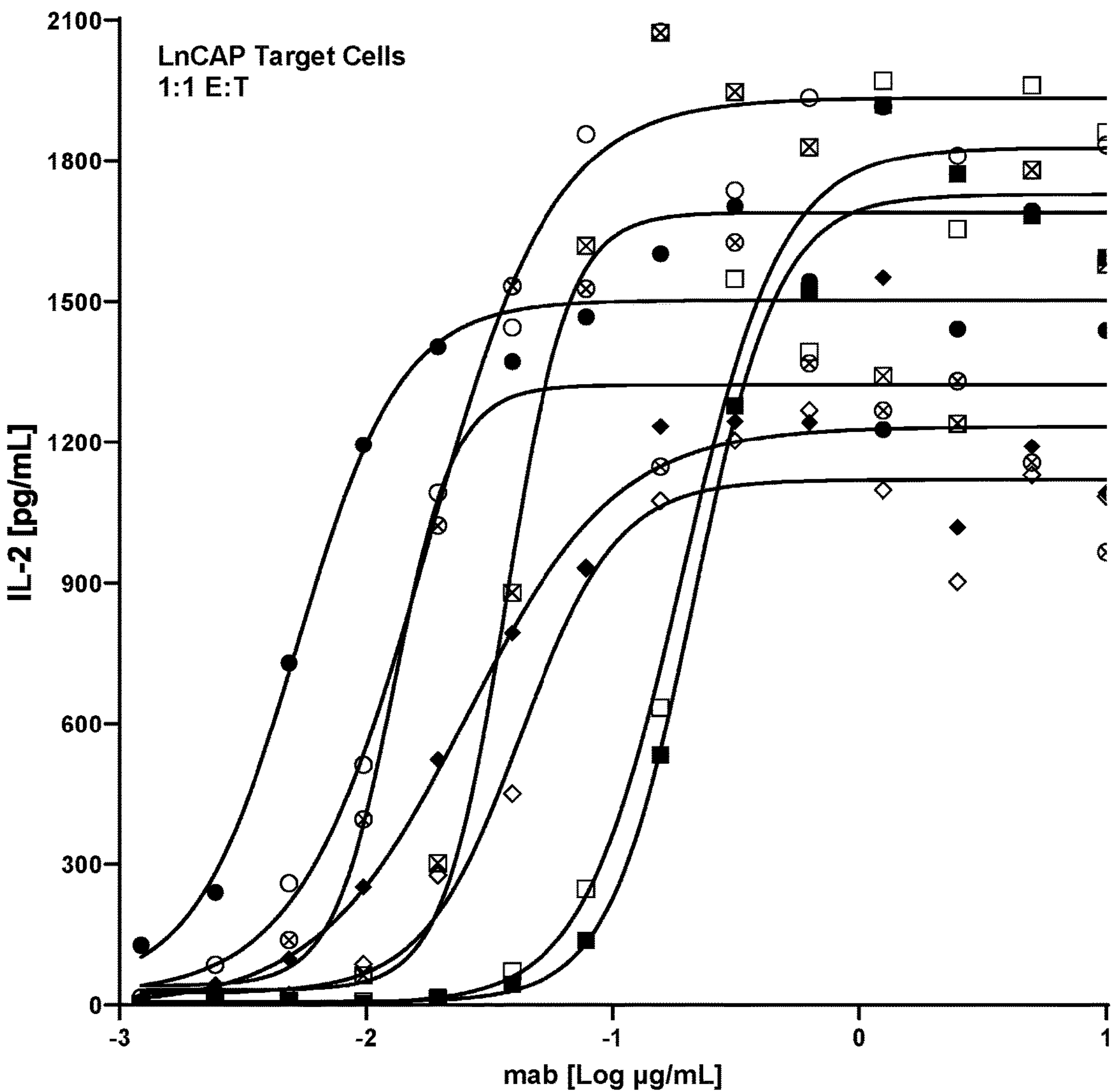
Figure 43C:
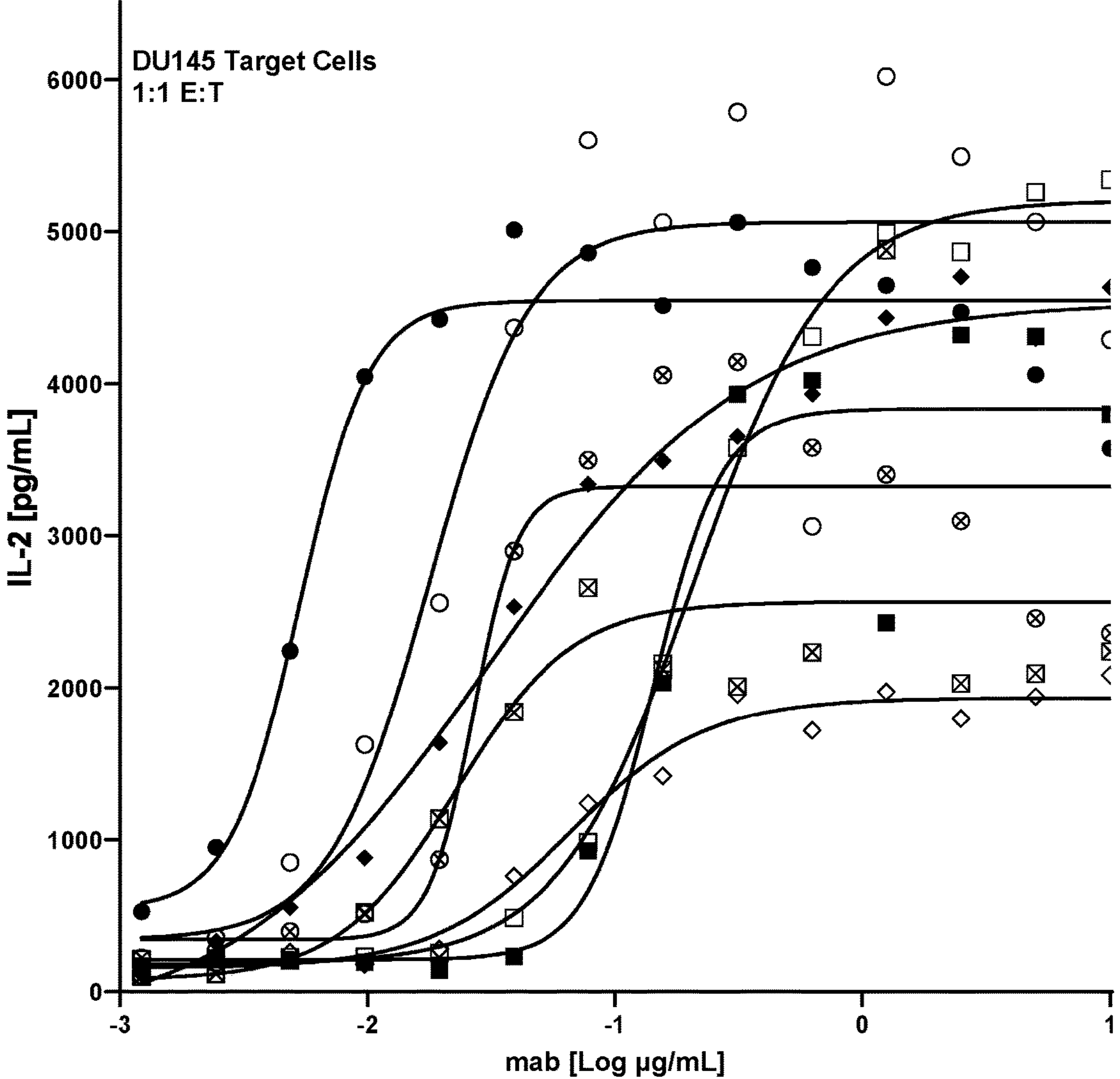

FIGS. 43A-43C depict induction of IL-2 secretion from T cells by B7H3×CD28 bsAbs in the presence of A) MDA-MB-231, B) LnCAP, and C) DU145 target cells (1:1 E:T ratio) and a constant dose of a illustrative B7H3 x CD3 bsAb.

FIG. 44 depicts consensus framework regions (FR) and complementarity determining regions (CDRs) (as in Kabat) for anti-CD28 clone 1A7 variable heavy and variable light domain variants.

FIGS. 45A-45D depict the pharmacokinetics of B7H3 x CD28 bsAbs in various antibody formats in a cynomolgus study. The data show that at each dose level investigated, the 2+1 common light chain format had the best half-life and pharmacokinetics.

FIGS. 46A-46H depict the change in serum concentration level over time in cynomolgus monkeys dosed with A) XENP34398, B) XENP37808, C) XENP37810, D) XENP34732, E) XENP35151, F) XENP351535, G) XENP37807, and H) XENP37982. Relative doses are depicted as follows: circle for 0.5X dose; upside down triangle for 1.3X dose; hexagon for 1.8X dose; square for 2X dose; diamond for 3.25X dose; star for 4.5X dose; and triangle for 5X dose.

FIG. 47 summarizes properties of B7H3 x CD28 bsAbs XENP34398, XENP37808, XENP34732, and XENP35153. It should be noted that some of the data depicted in this summary table may not be the same experimental data depicted elsewhere in the Working Examples as some of those illustrate experimental data from earlier stages of development.

Figure 48A:
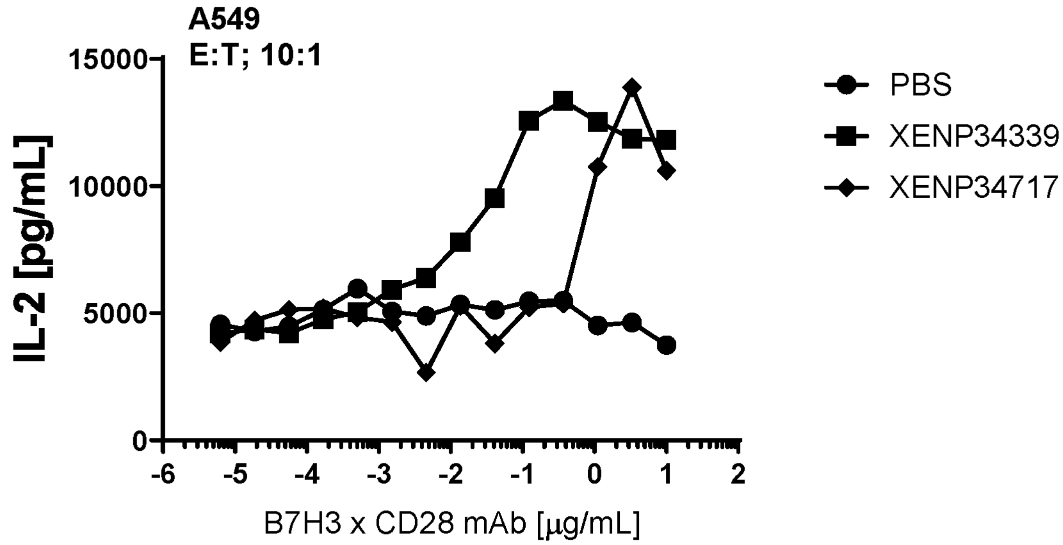
Figure 48B:
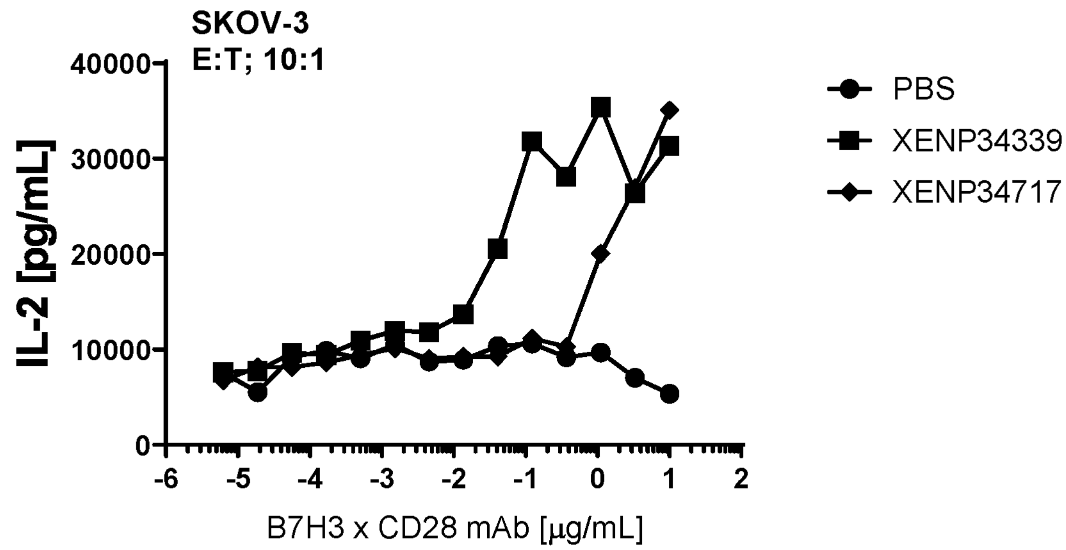

FIGS. 48A and 48B depict IFNγ release following incubation of A) A549 cancer cells and B) SKOV-3 cancer cells with $CD3^+$ T cells (10:1 effector:target ratio) and indicated concentration of B7H3 x CD28 bispecific antibodies XENP34339 or XENP34717. The data show that both XENP34339 and XENP34717 induced cytokine release by the T cells. XENP34339 having bivalent B7H3 binding induced cytokine release more potently than XENP34717 having monovalent B7H3 binding.

Figure 49:
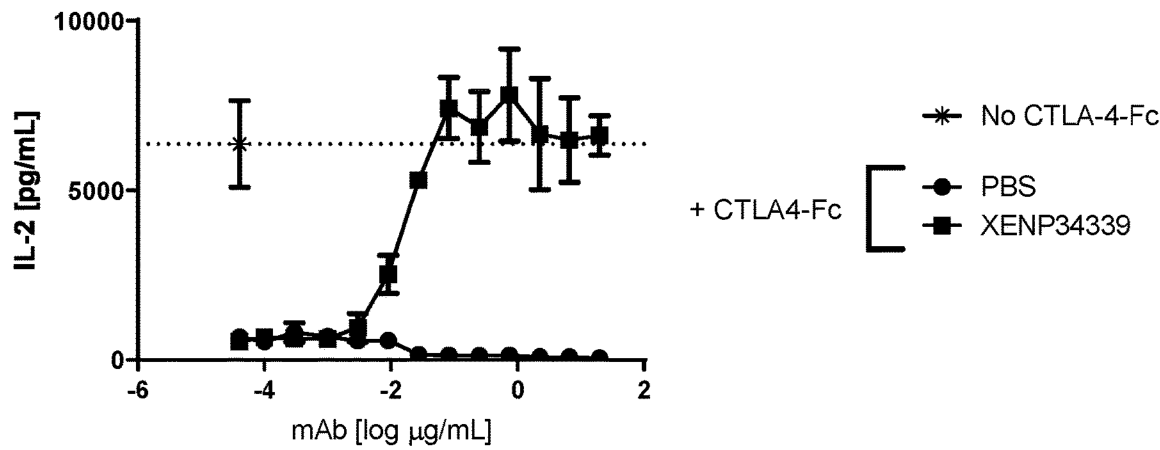

FIG. 49 depicts the restoration of CD28 signaling in a mixed lymphocyte reaction (following incubation of with 1 μg/mL CTLA-4-Fc) by XENP34339. Error bars represent the mean expression in culture supernatants from one MLR reaction tested in technical quadruplicate.

Figure 50A:
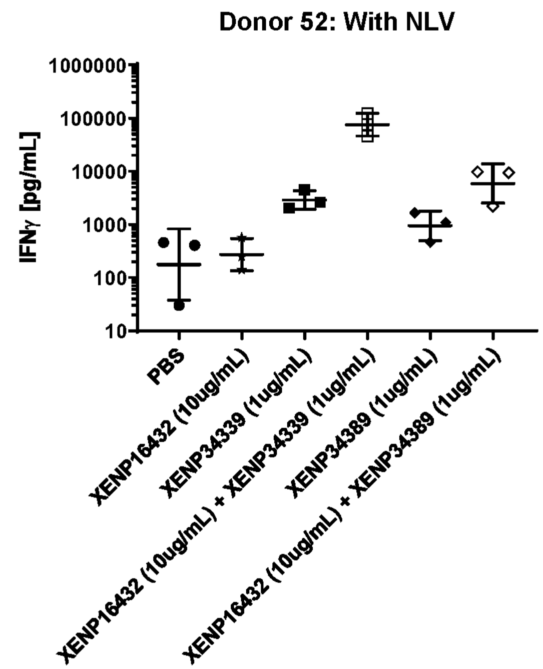
Figure 50B:
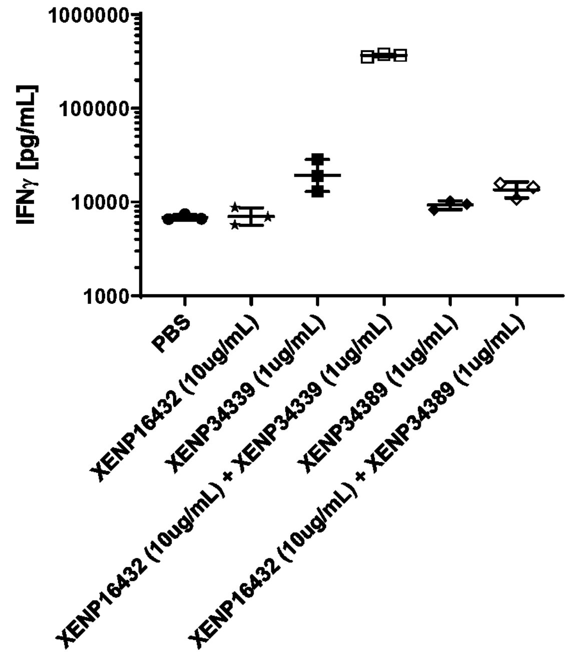

FIGS. 50A and 50B depict IFNγ release following incubation of NLV-loaded MDA-MB-231 cancer cells with $CD3^+$ T cells purified from A) a first donor and B) a second donor at a 10:1 effector:target ratio and the indicated combinations of XENP16432, XENP34339, and XENP34389. The data show that incubation with XENP34339 alone induced cytokine release from T cells and combined synergistically with PD-1 blockade to enhance cytokine release.

Figure 51:
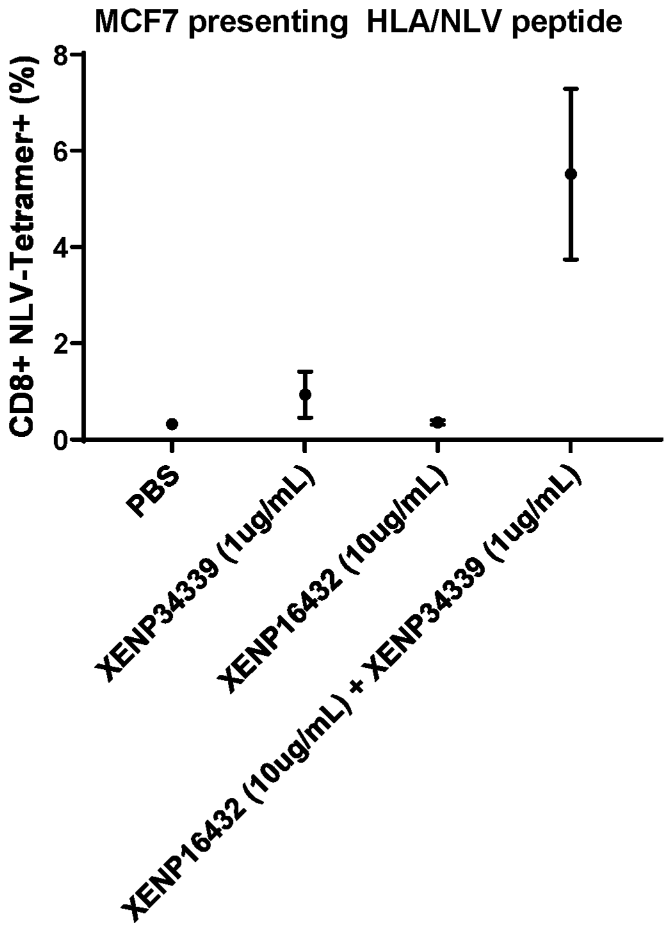

FIG. 51 depicts expansion of NLV-tetramer positive cells following incubation of NLV-loaded MCF7 cancer cells with purified $CD3^+$ T cells purified at a 10:1 effector:target ratio and the indicated combinations of XENP16432 and XENP34339. The data show that combination of XENP34339 with PD-1 blockade enhanced expansion of NLV-tetramer positive $CD8^+$ T cells.

Figure 52A:
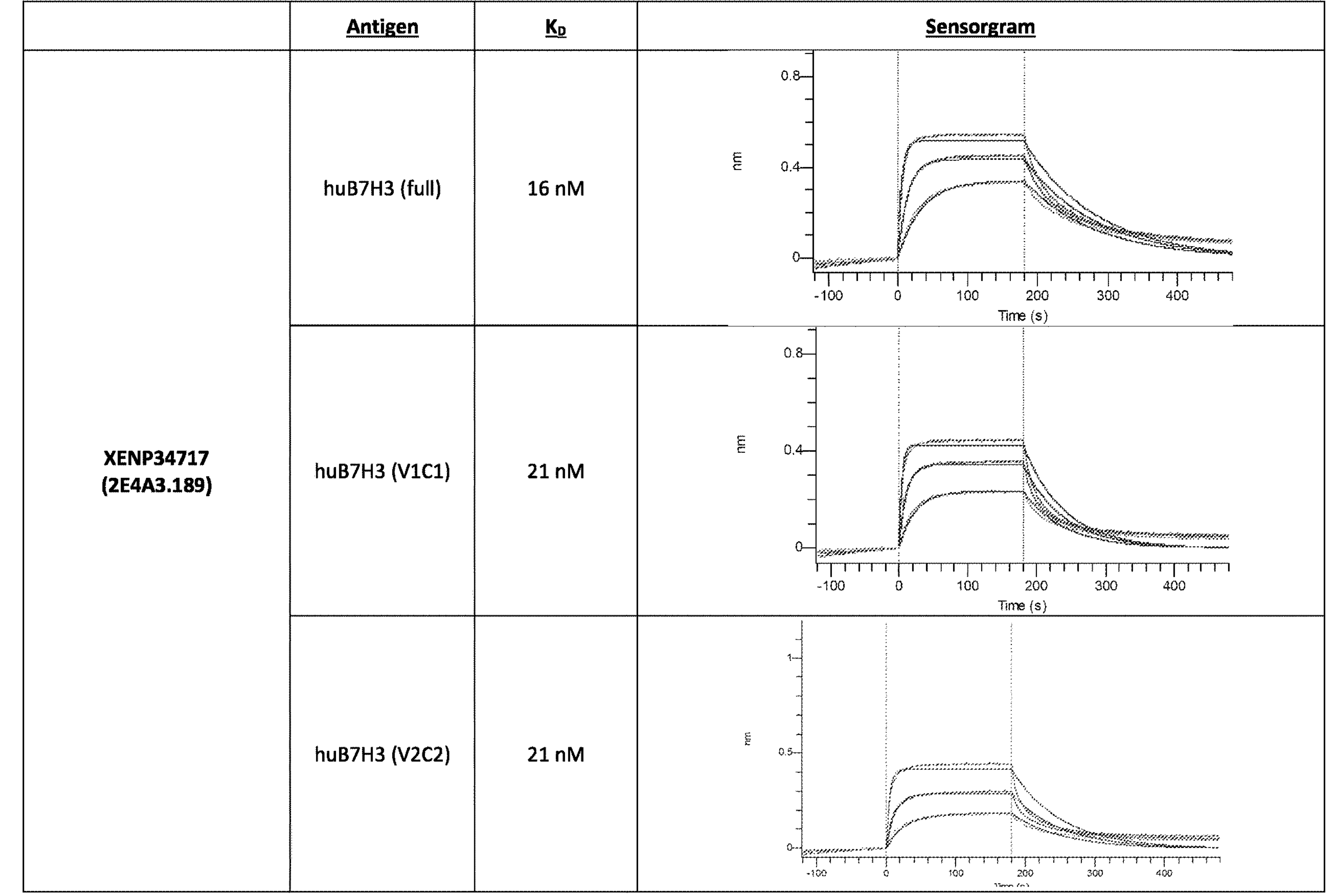
Figure 52B:
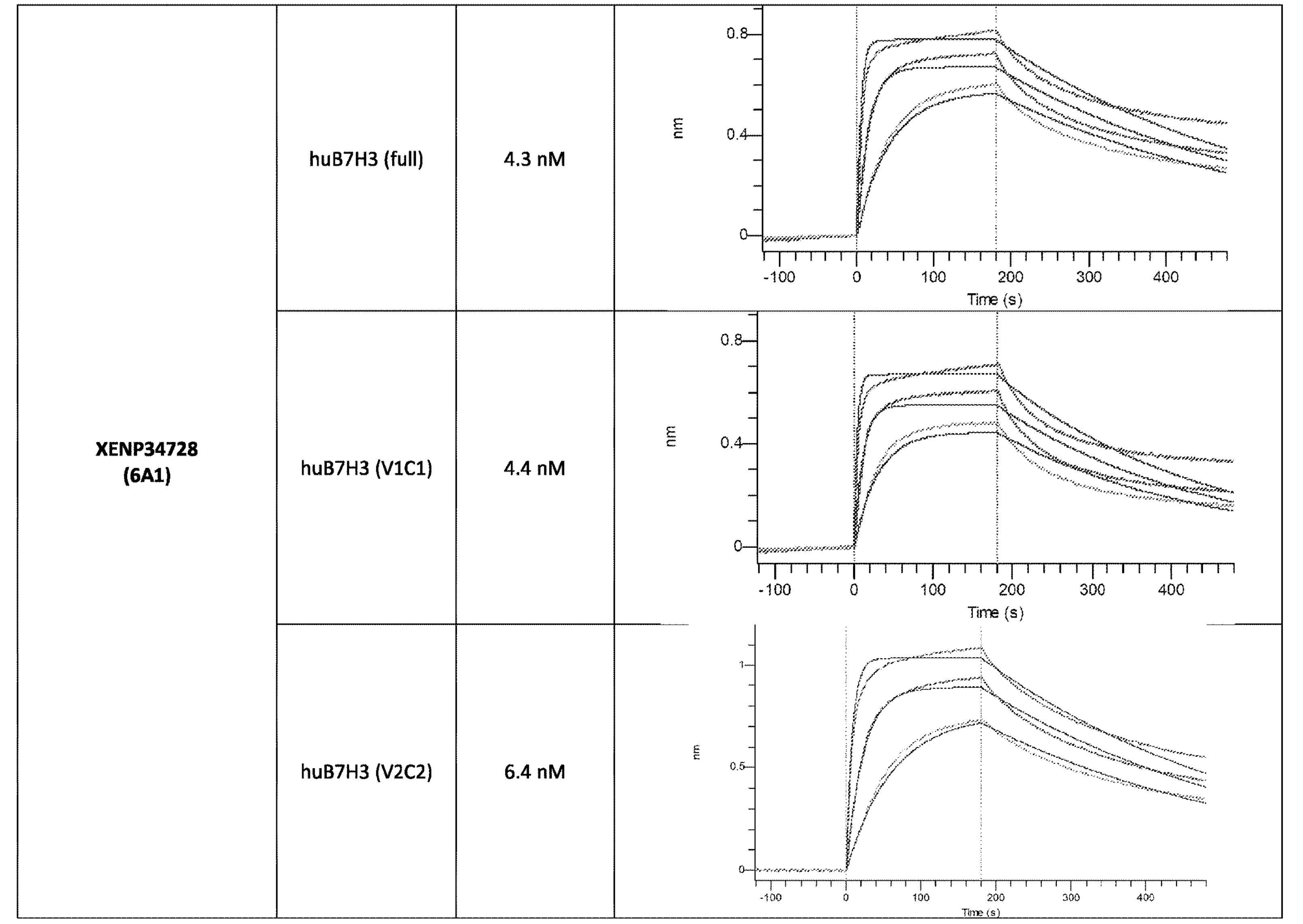

FIGS. 52A and 52B depicts the dissociation constant ($K_D$; and corresponding sensorgrams) of anti-B7H3 clone 2E4A3.189 and clone 6A1 for either the full B7H3 extracellular V1C1-V2V2 domain or the individual V1C1 or V2C2 domains.

Figure 53:
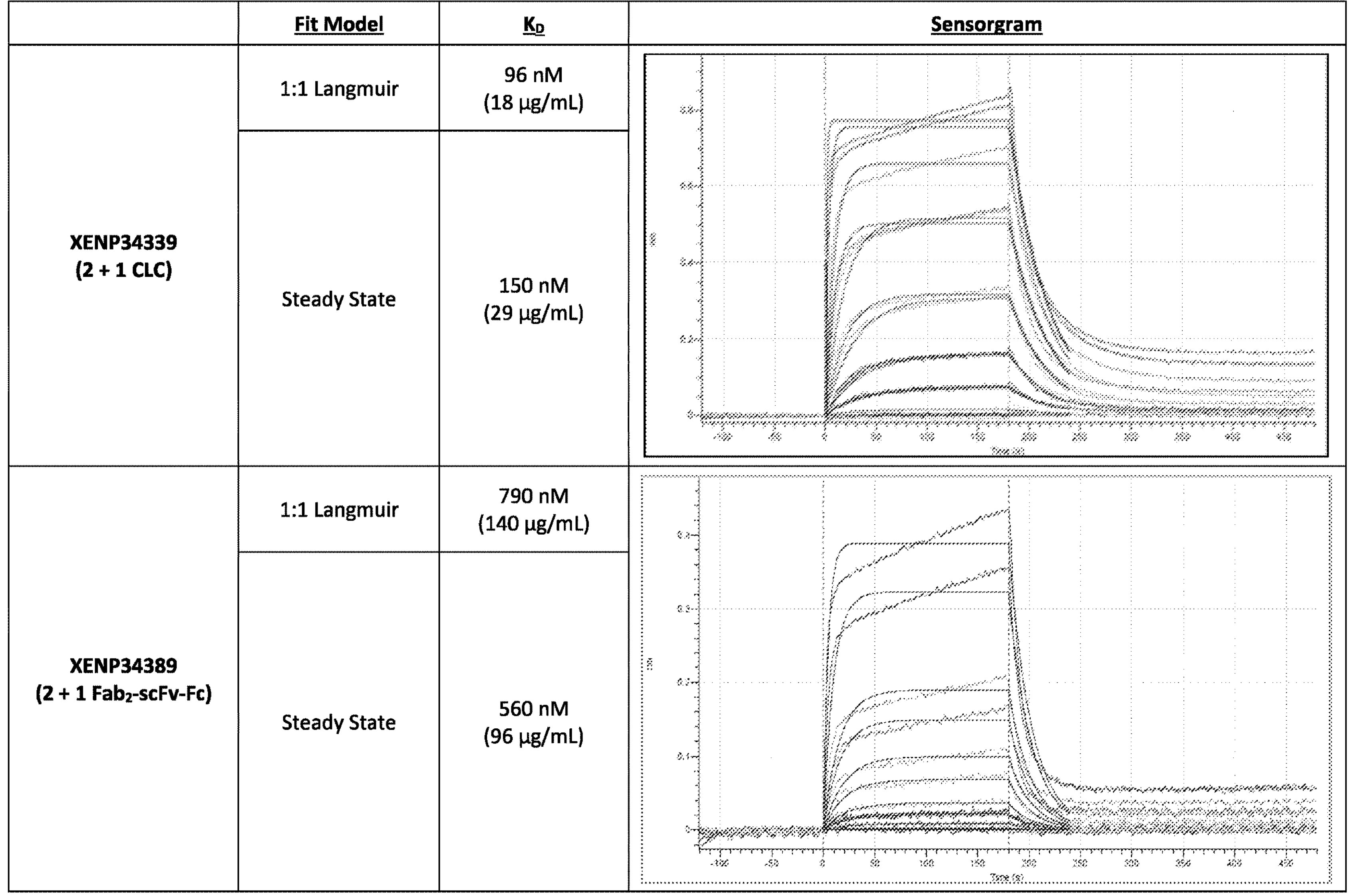

FIG. 53 depicts the dissociation constant ($K_D$; and corresponding sensorgrams) of anti-CD28 clone 1A7 affinity variant H1.14_L1 as a Fab in the 2+1 CLC format or as an scFv in the 2+1 $Fab_2$-scFv-Fc format for CD28 antigen.

FIGS. 54A and 54B depict the sequences for illustrative αPSMA x αCD3 bsAbs in the 2+1 $Fab_2$-scFv-Fc format and comprising a H1.30_L1.47 anti-CD3 scFv (a.k.a. CD3 High [VHVL]). CDRs are underlined and slashes indicate the border(s) between the variable regions and other chain components (e.g. constant region and domain linkers). It should be noted that the αPSMA x αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

Figure 55:
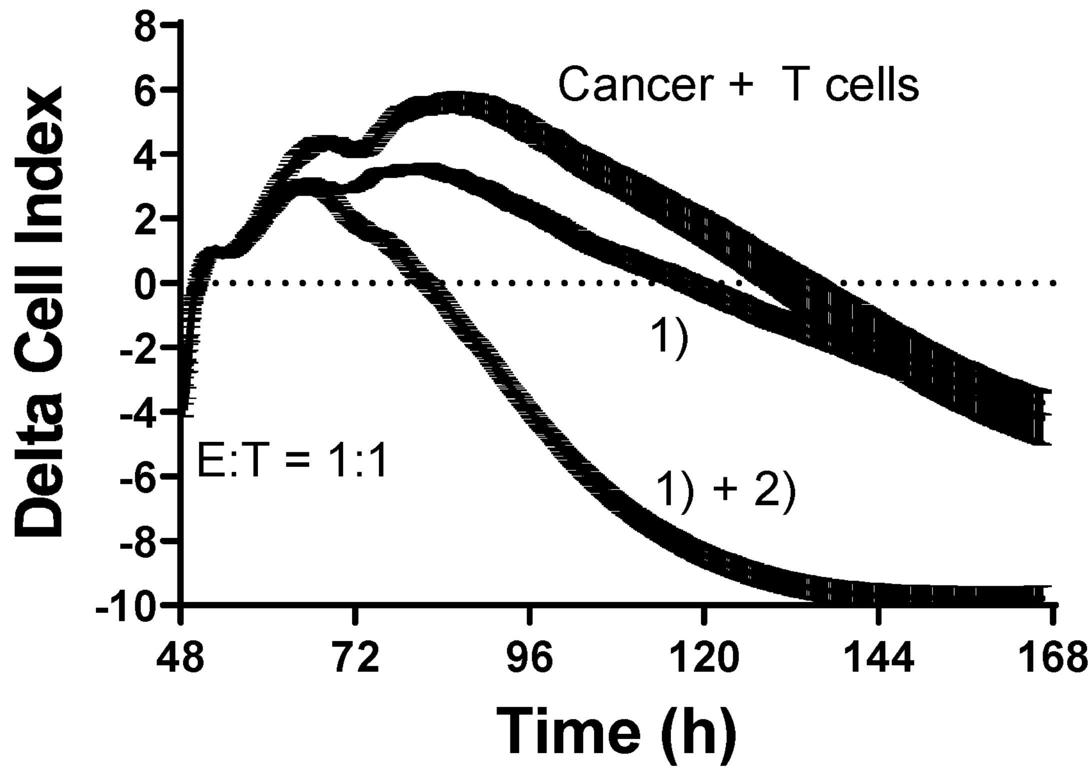
Figures 61A, 61B, 61C, 61D, 61E:
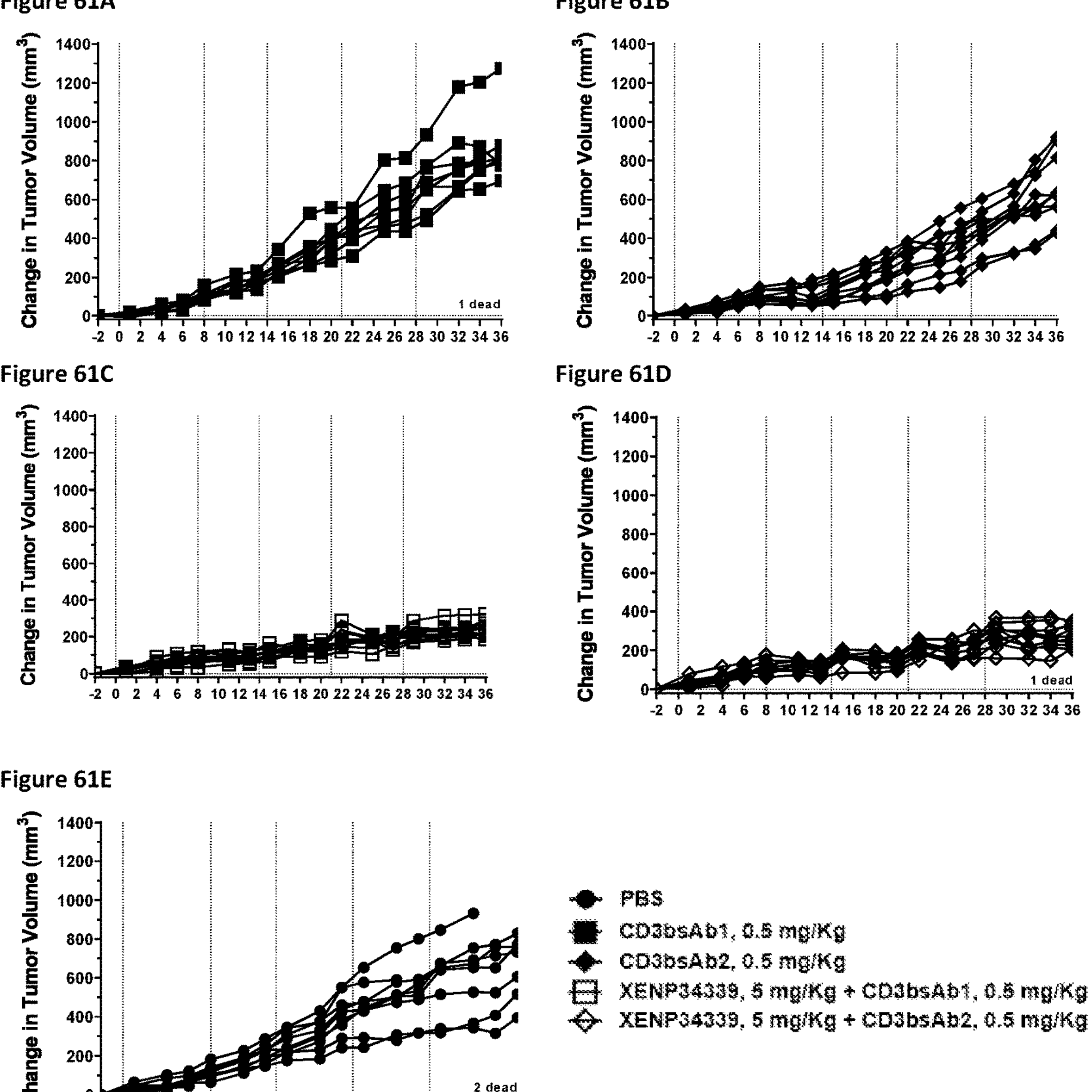

FIG. 55 depicts cell kill over time following incubation of LNCaP cancer cells ($PSMA^+B7H3^+$) with $CD3^+$ T cells at a 1:1 effector:target ratio and illustrative CD3 bispecific (αPSMA x αCD3 XENP31602) alone or in combination with XENPXENP34339 at the indicated concentrations. The data show that XENP31602 αPSMA x αCD3 alone minimally enhanced cell kill in comparison to incubation of cancer and T cells alone. Addition of XENP34339 αB7H3 x αCD28 overcomes cancer cell resistance to the CD3 bispecific.

FIGS. 56A-56L depict sequences for exemplary anti-CD3 binding domains suitable for use in CD3 bispecific antibodies which may be combined with the CD28 bispecific antibodies of the invention. The CDRs are underlined, the scFv linker is double underlined (in the sequences, the scFv linker is a positively charged scFv $(GKPGS)_4$ linker (SEQ ID NO: 796), although as will be appreciated by those in the art, this linker can be replaced by other linkers, including uncharged or negatively charged linkers, some of which are depicted in FIG. 6), and the slashes indicate the border(s) of the variable domains. In addition, the naming convention illustrates the orientation of the scFv from N- to C-terminus. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIGS. 57A-57C depict A) IFNγ release, B) IL-2 release, and C) $CD3^+$ T cell expansion following incubation of LNCaP cancer cells ($PSMA^+B7H3^+$) with $CD3^+$ T cells at a 1:1 effector:target ratio and 1 μg/ml XENP34339 in combination with a dose titration of an illustrative CD3 bispecific (αPSMA x αCD3 XENP31602).

FIGS. 58A-58C depict A) IFNγ release, B) IL-2 release, and C) $CD3^+$ T cell expansion following incubation of 22Rvl cancer cells ($PSMA^+B7H3^+$) with $CD3^+$ T cells at a 1:1 effector:target ratio and 1 μg/ml XENP34339 in combination with a dose titration of an illustrative CD3 bispecific (αPSMA x αCD3 XENP31602).

FIGS. 59A-59C depict A) IFNγ release, B) IL-2 release, and C) $CD3^+$ T cell expansion following incubation of SKOV-3 cancer cells ($PSMA^-B7H3^+$) with $CD3^+$ T cells at a 1:1 effector:target ratio and 1 μg/ml XENP34339 in combination with a dose titration of an illustrative CD3 bispecific (αPSMA x αCD3 XENP31602).

FIGS. 60A-60C depict A) IFNγ release, B) IL-2 release, and C) $CD3^+$ T cell expansion following incubation of OVCAR-8 cancer cells ($PSMA^-B7H3^+$) with $CD3^+$ T cells at a 1:1 effector:target ratio and 1 μg/ml XENP34339 in combination with a dose titration of an illustrative CD3 bispecific (αPSMA x αCD3 XENP31602).

Figure 62:
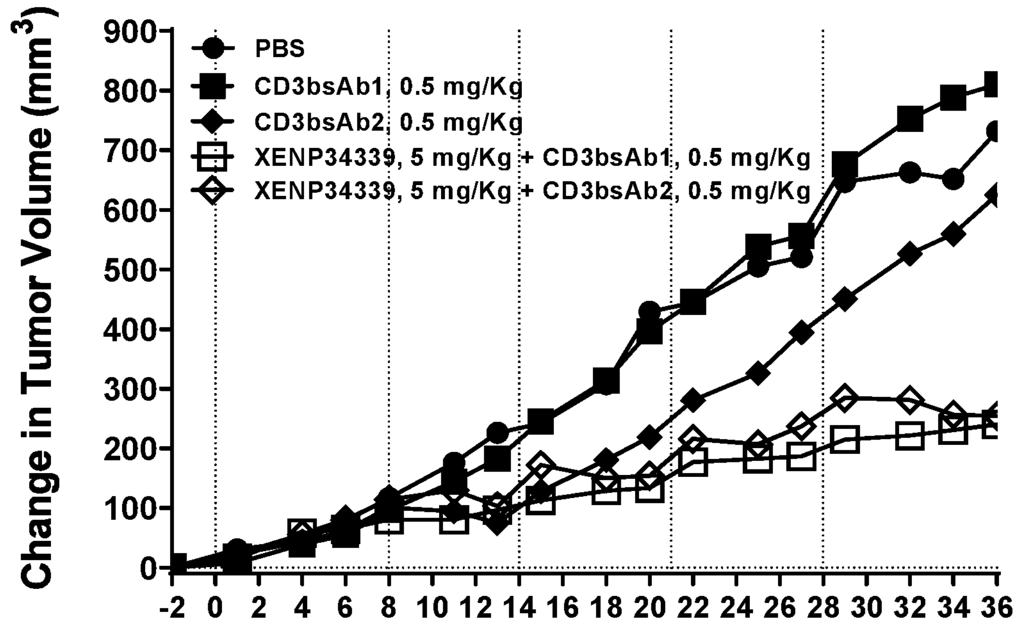

FIGS. 61A-61E depict change in tumor volume (as determined by caliper measurement; baseline corrected) in individual mouse over time (in days) in pp65-MDA-MB-231 and huPBMC-engrafted NSG mice dosed with A) a first illustrative B7H3 x CD3 bispecific antibody (CD3bsAb1) (0.5 mg/kg) alone, B) a second illustrative B7H3 x CD3 bispecific antibody (CD3bsAb2) (0.5 mg/kg) alone, C) a combination of XENP34339 (5.0 mg/kg) with CD3bsAb1 (0.5 mg/kg), D) a combination of XENP34339 (5.0 mg/kg) with CD3bsAb2 (0.5 mg/kg), or E) PBS. F) depicts FIG. 62 depicts group median change in tumor volume (as determined by caliper measurement; baseline corrected) over time (in days) in pp65-MDA-MB-231 and huPBMC-engrafted NSG mice dosed with a first illustrative B7H3 x CD3 bispecific antibody (CD3bsAb1) (0.5 mg/kg) alone, a second illustrative B7H3 x CD3 bispecific antibody (CD3bsAb2) (0.5 mg/kg) alone, a combination of XENP34339 (5.0 mg/kg) with CD3bsAb1 (0.5 mg/kg), a combination of XENP34339 (5.0 mg/kg) with CD3bsAb2 (0.5 mg/kg), or PBS control.

Figure 63:
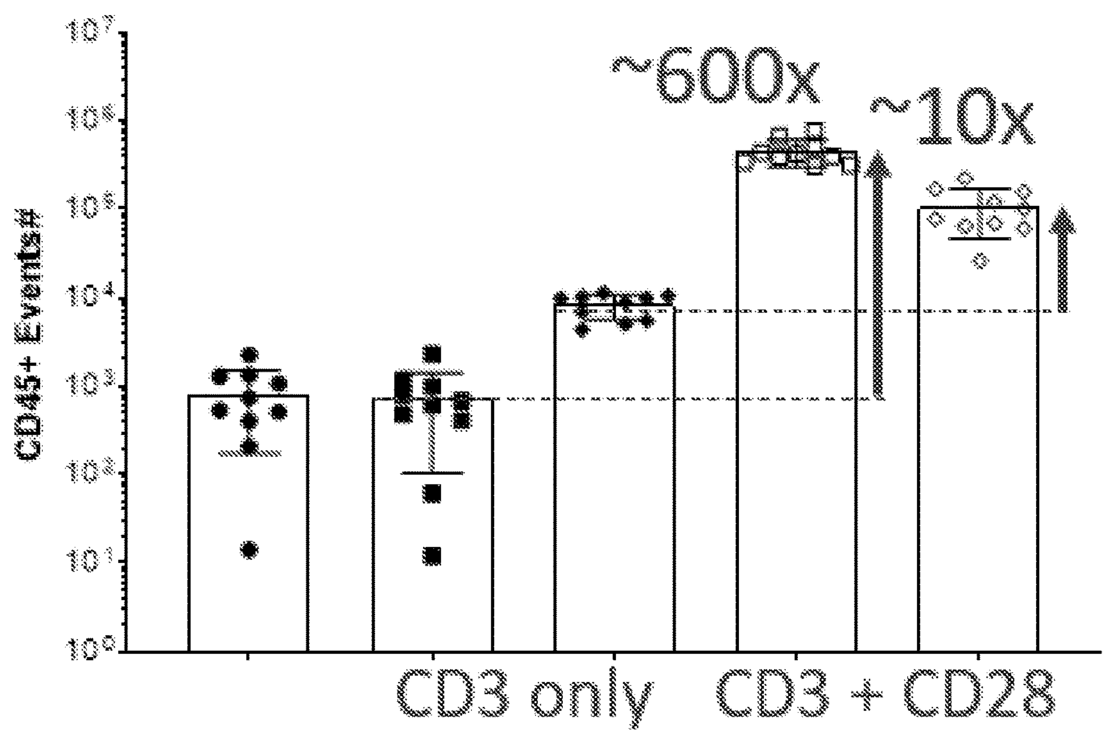
Figures 64A, 64B, 64C, 64D, 64E:
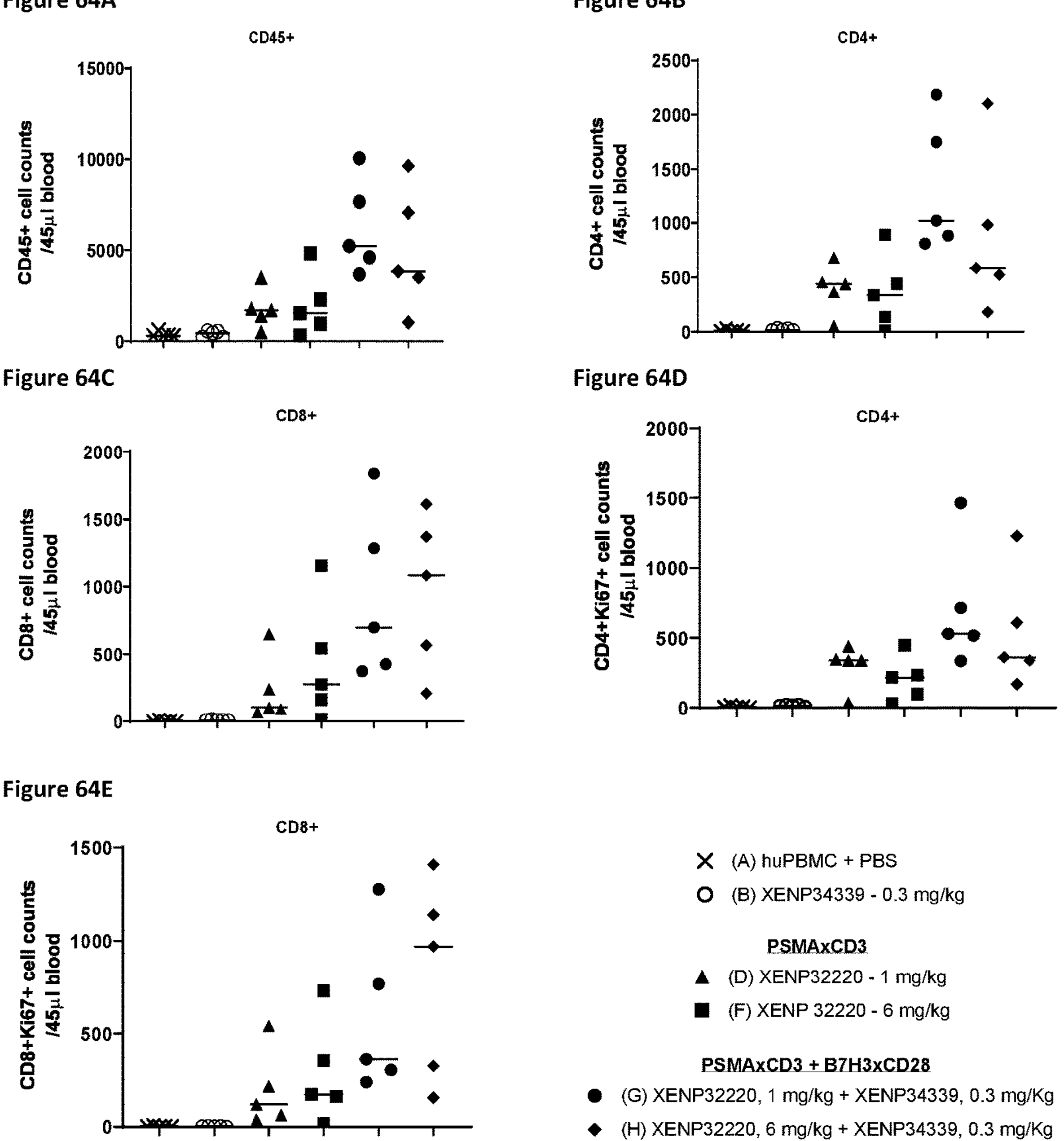
Figures 65A, 65B, 65C, 65D:
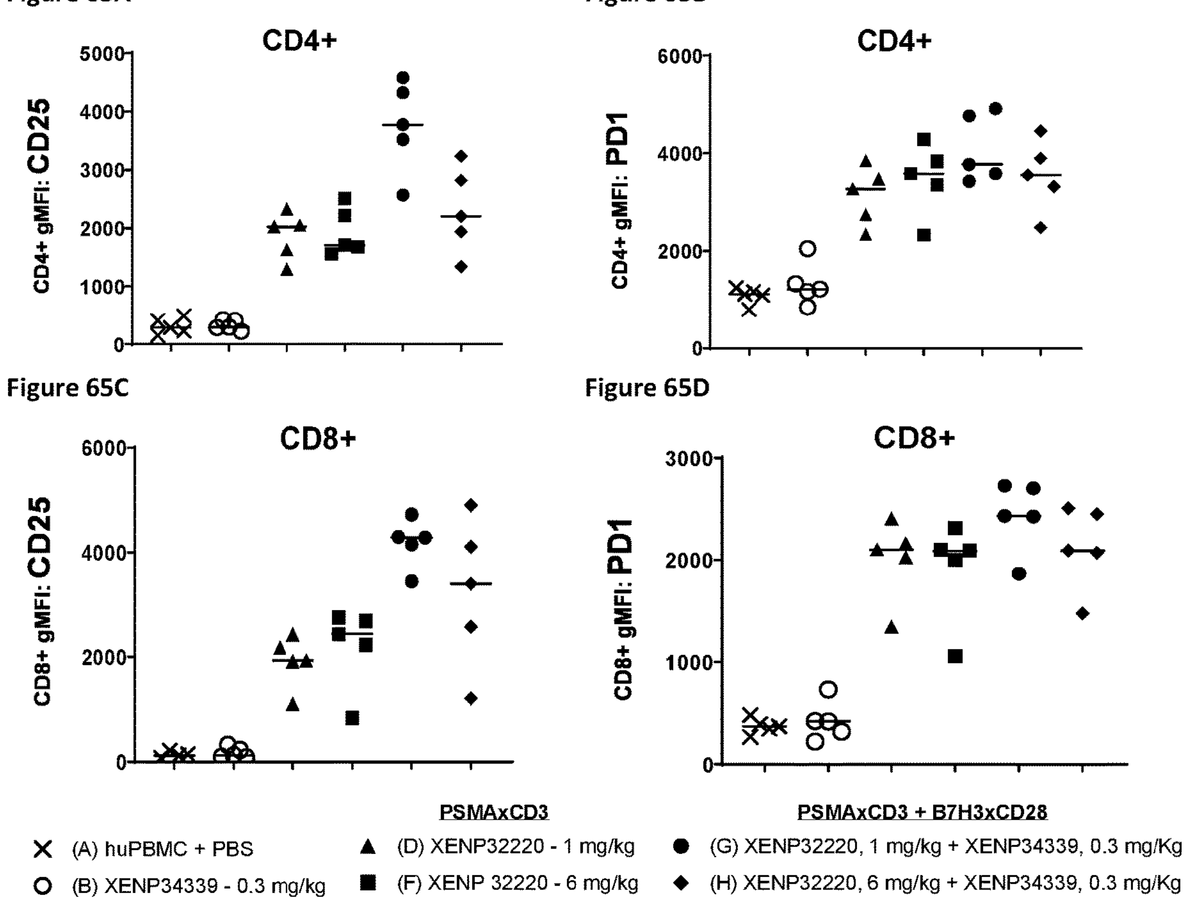

FIG. 63 depicts CD45+cell counts in blood of pp65-MDA-MB-231 and huPBMC-engrafted NSG mice dosed with a first illustrative B7H3 x CD3 bispecific antibody (CD3bsAb1) (0.5 mg/kg) alone, a second illustrative B7H3 x CD3 bispecific antibody (CD3bsAb2) (0.5 mg/kg) alone, a combination of XENP34339 (5.0 mg/kg) with CD3bsAb1 (0.5 mg/kg), a combination of XENP34339 (5.0 mg/kg) with CD3bsAb2 (0.5 mg/kg), or PBS control on Day 14 after first dose.

FIGS. 64A-64E depict expansion of A) CD45+, B) CD4+ (all), C) CD8+ (all), D) CD4+ (Ki67+), and E) CD8+ (Ki67+) cells in blood (as indicated by count) of 22RV1 and huPBMC-engrafted NSG-DKO mice dosed with a low or high concentration doses of illustrative PSMA x CD3 bsAb XENP32220 alone or in combination with XENP34339. Treatment with both CD3 and CD28 bsAbs enhanced T cell expansion in comparison to treatment with CD3 bsAb alone.

FIGS. 65A-65D depicts A) activation of CD4+ cells (as indicated by CD25 expression), B) activation of CD4+cells (as indicated by PD1 expression), C) activation of CD8+ cells (as indicated by CD25 expression), and D) activation of CD8+ cells (as indicated by PD1 expression) in blood (as indicated by count) of 22RV1 and huPBMC-engrafted NSG-DKO mice dosed with a low or high concentration doses of illustrative PSMA x CD3 bsAb XENP32220 alone or in combination with XENP34339. Treatment with both CD3 and CD28 bsAbs enhanced T cell activation in comparison to treatment with CD3 bsAb alone.

Figure 66:
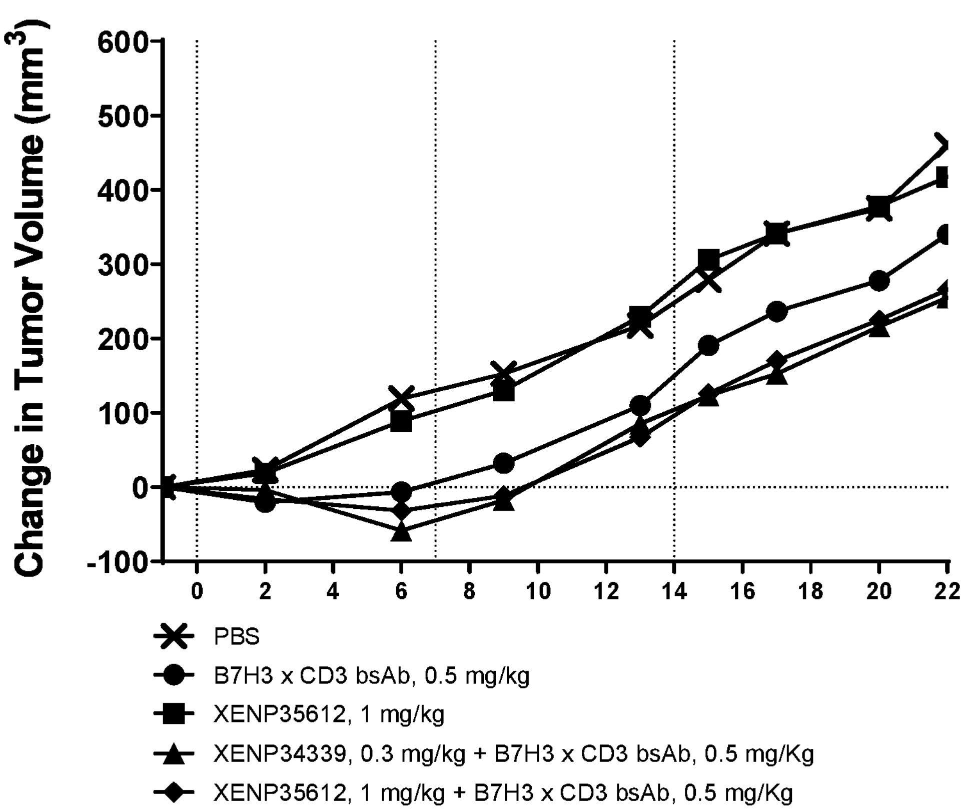

FIG. 66 depicts group median change in tumor volume (as determined by caliper measurement; baseline corrected) over time (in days) in pp65-MDA-MB-231-engrafted CD34+ Hu-NSG mice dosed with an illustrative B7H3 x CD3 bispecific antibody (0.5 mg/kg) alone, XENP35612 alone (1 mg/kg) alone, a combination of XENP34339 (0.3 mg/kg) with the B7H3 x CD3 bsAb (0.5 mg/kg), a combination of XENP35612 (1 mg/kg) with the B7H3 x CD3 bsAb (0.5 mg/kg), or PBS control.

Figures 67A, 67B:
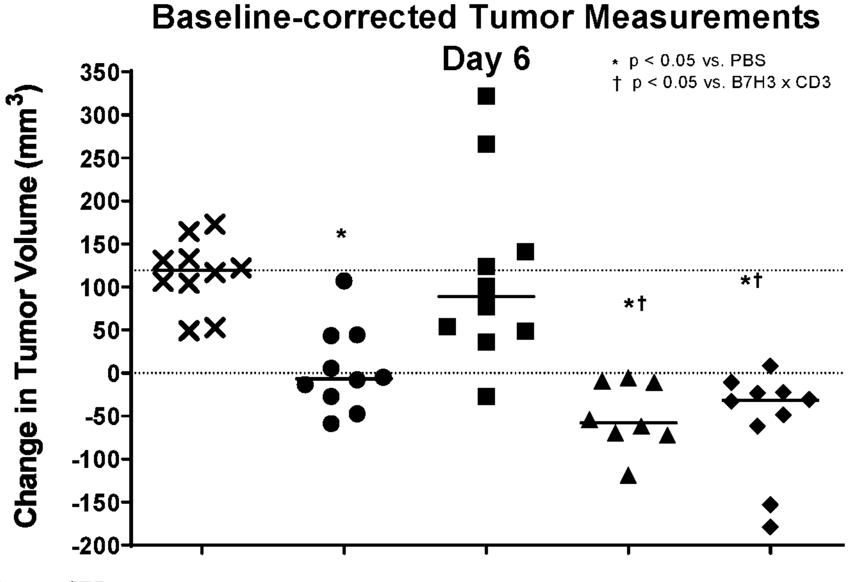

FIGS. 67A and 67B depict baseline corrected tumor volume on A) Day 6 and B) Day 9 (post-dose) in pp65-MDA-MB-231-engrafted CD34+Hu-NSG mice dosed with a illustrative B7H3 x CD3 bispecific antibody (0.5 mg/kg) alone, XENP35612 alone (1 mg/kg) alone, a combination of XENP34339 (0.3 mg/kg) with the B7H3 x CD3 bsAb (0.5 mg/kg), a combination of XENP35612 (1 mg/kg) with the B7H3 x CD3 bsAb (0.5 mg/kg), or PBS control. Statistics performed on baseline corrected data using Mann-Whitney test.

Figure 68A:
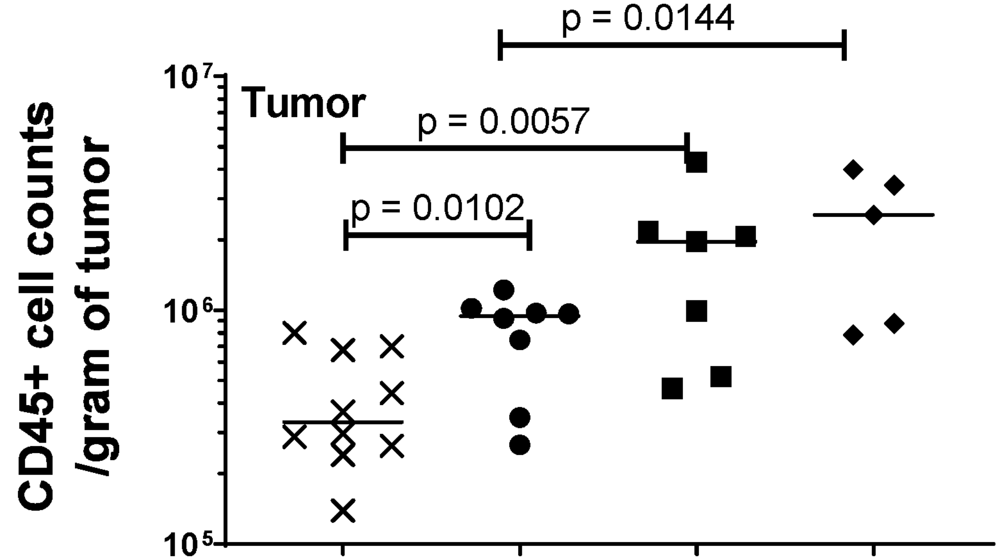
Figure 68B:
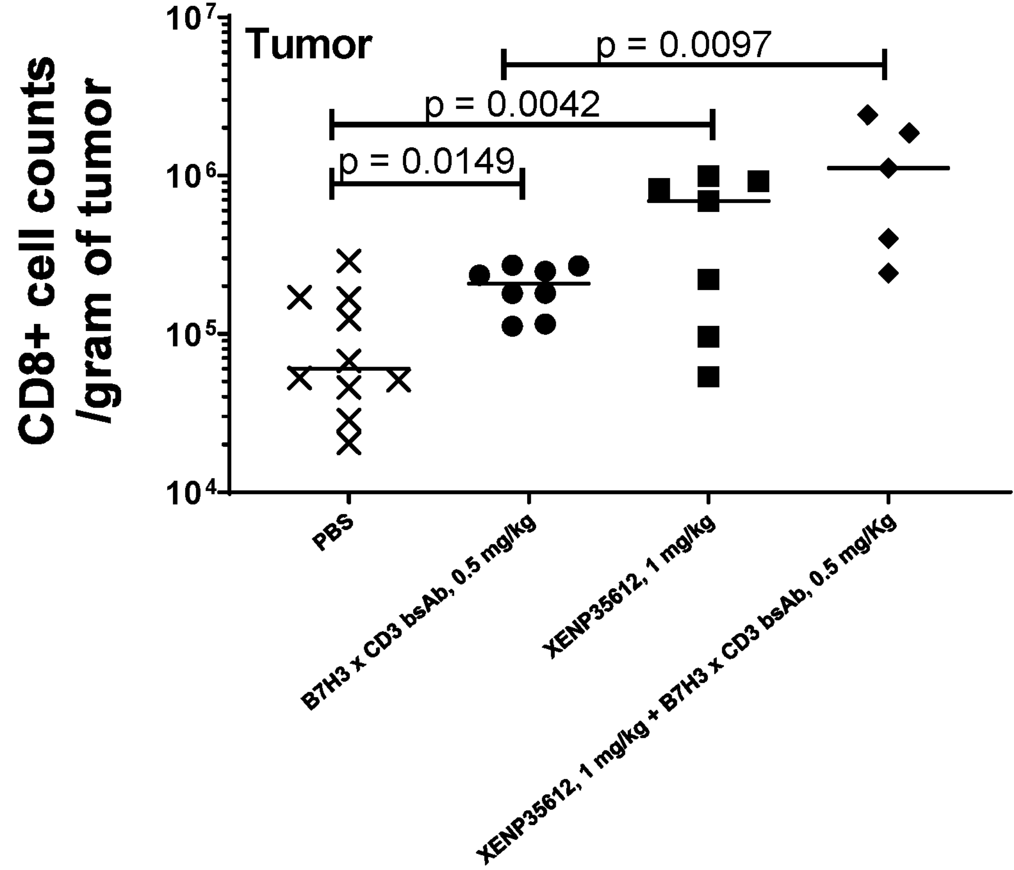

FIGS. 68A and 68B depict expansion of A) CD45+ and B) CD8+ cells in tumor of pp65-MDA-MB-231-engrafted CD34+ Hu-NSG mice dosed with an illustrative B7H3 x CD3 bispecific antibody (0.5 mg/kg) alone, XENP35612 alone (1 mg/kg) alone, a combination of XENP35612 (1 mg/kg) with the B7H3 x CD3 bsAb (0.5 mg/kg), or PBS control. Statistics performed on log-transformed data using unpaired t-test.

FIG. 69 depicts the sequences for XENP29154, which is in-house produced TGN1412.

Figure 70A:
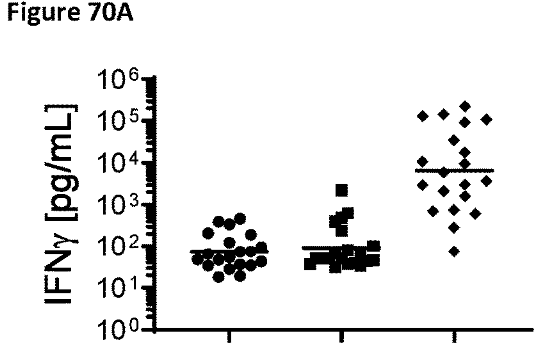
Figure 70B:
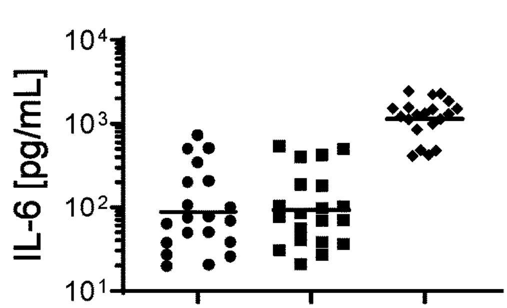
Figure 70C:
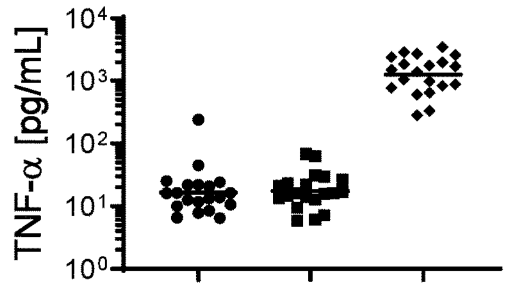

FIGS. 70A-70C depict the release of A) IFNγ, B) IL-6, and C) TNFα from human PBMCs treated with air-dried XENP34339, TGN1412 (XENP29154), or negative control PBS.

FIGS. 71A-71C depict the release of A) IFNγ, B) IL-2, and C) TNFα from human PBMCs treated with air-dried XENP37808, TGN1412 (XENP29154), or negative control PBS.

Figure 72A:
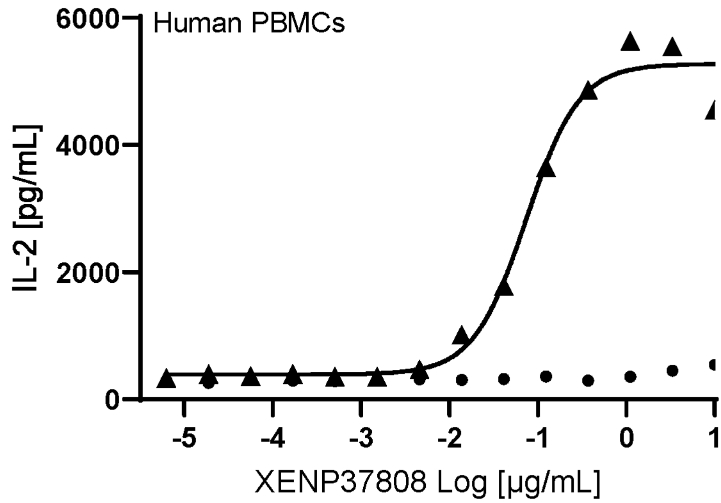
Figure 72B:
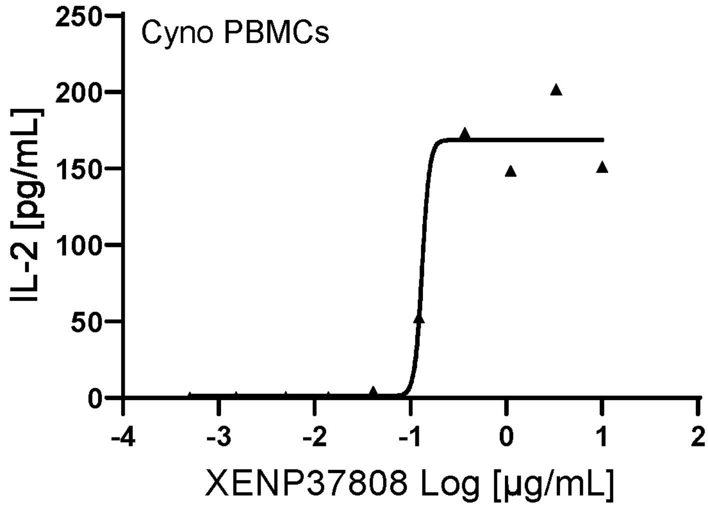

FIGS. 72A and 72 B depict induction of IL-2 release by A) PBMCs from a human donor or B) PBMCs from a cynomolgus donor by XENP37808 in the presence of HEK cells transfected with αCD3 scFv (with or without B7H3 knockout).

Figure 73A:
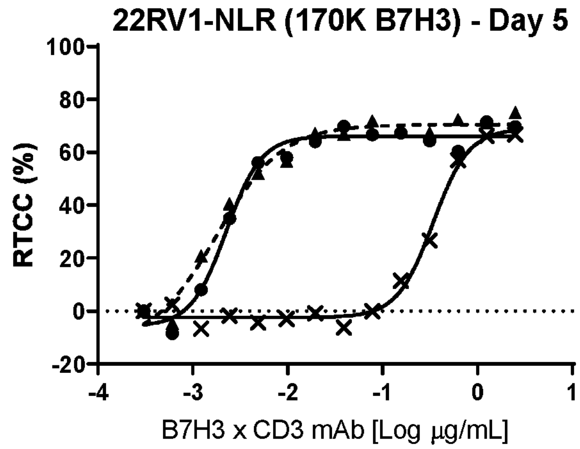
Figure 73B:
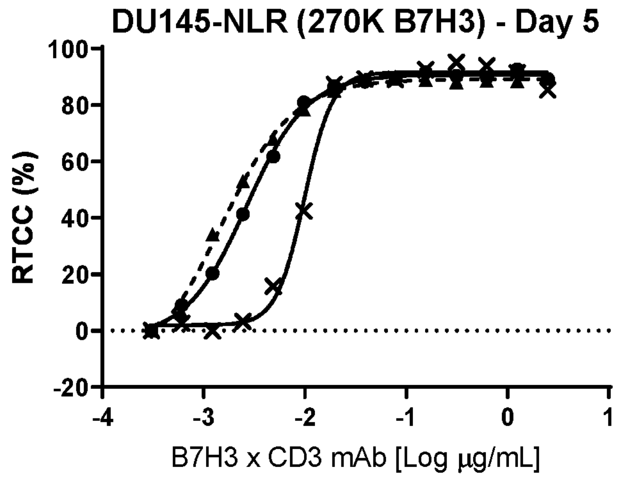

FIGS. 73A and 73B depict induction of RTCC on A) 22RV-NLR (having ~170K B7H3 antigen density) and B) DU145-NLR (having ~270K B7H3 antigen density) target cells B7H33 x CD3 mAb alone, or in combination with either XENP34398 or XENP37808. The data show that XENP34398 and XENP37808 (in combination with B7H3 x CD3) induce very similar levels of RTCC.

FIGS. 74A-74C depict induction of IL-2 release by T cells in the presence of A) OVCAR8 (having ~20K B7H3 antigen density), B) 22RV1-NLR (having ~170K B7H3 antigen density), and C) DU145-NLR (having ~270K B7H3 antigen density), and XENP34398 or XENP37808 in combination with a B7H3 x CD3 bsAb.

FIG. 75 depicts consensus framework regions (FR) and complementarity determining regions (CDRs) (as in Kabat) for anti-B7H3 clone 2E4A3.189 variable heavy and variable light domain variants.

DETAILED DESCRIPTION

I. Overview

The activation of T cells in the treatment of cancer is being widely investigated. T cells require multiple signals for complete activation and differentiation. As shown in FIG. 40, Signal 1, promoted by recognition of a peptide-MHC (pMHC) complex by the T cell receptor (TCR), is absolutely required for T cell activation. Signal 2, which synergizes with, and amplifies signal 1, is typically provided by the interaction of the CD28 ligands CD80 and CD86 with CD28 itself. Although CD28 engagement alone is typically inert, when combined with signal 1 activation, it promotes additional activation, survival, and proliferative signals, including IL2 secretion. As CD80 and CD86 are only naturally expressed by professional antigen-presenting cells (APC), the extent of CD28 costimulation in the tumor setting can be highly variable. Accordingly, the present invention is directed to a novel class of tumor-targeted CD28 bispecific antibodies (including B7H3 x CD28 more fully described herein), the CD80/CD86 engagement of CD28 can be mimicked, providing an artificial source of signal 2. Notably, signal can either be provided by the natural TCR: pMHC recognition of tumor cells, or it can be provided by combination of the CD28 bispecific with a CD3 bispecific (which can mimick signal 1).

Accordingly, provided herein are novel anti-CD28 x anti-B7H3 (also referred to as "αCD28 x αB7H3" and sometimes "CD28 x B7H3") bispecific antibodies and methods of using such antibodies for the treatment of cancers. In many cases, these bispecific antibodies are heterodimeric. Subject αCD28 x αB7H3 antibodies are capable of agonistically binding to CD28 costimulatory molecules on T cells and targeting to B7H3 on tumor cells. Thus, such antibodies selectively enhance anti-tumor activity at tumor sites while minimizing peripheral toxicity. The subject antibodies provided herein are particularly useful for enhancing anti-tumor activity either alone, as a monotherapy, or when used in combination with other anti-cancer therapies as more fully described herein Accordingly, in one aspect, provided herein are heterodimeric antibodies that bind to two different antigens, e.g., the antibodies are "bispecific," in that they bind two different target antigens, generally CD28 and B7H3 as described below. These heterodimeric antibodies can bind each of the target antigens either monovalently (e.g., there is a single antigen binding domain such as a variable heavy and variable light domain pair) or bivalently (there are two antigen binding domains that each independently bind the antigen). In some embodiments, the heterodimeric antibody provided herein includes one CD28 binding domain and one B7H3 binding domain (e.g., heterodimeric antibodies in the "1+1 Fab-scFv-Fc" format described herein, which are thus bispecific and bivalent). In other embodiments, the heterodimeric antibody provided herein includes one CD28 binding domain and two B7H3 binding domains (e.g., heterodimeric antibodies in the "2+1 $Fab_2$-scFv-Fc" formats described herein, which are thus bispecific but trivalent, as they contain three antigen binding domains (ABDs)). The heterodimeric antibodies provided herein are based on the use of different monomers that contain amino acid substitutions (i.e., skew variants") that "skew" formation of heterodimers over homodimers, as is more fully outlined below. In some embodiments, the heterodimer antibodies are also coupled with "pI variants" that allow simple purification of the heterodimers away from the homodimers, as is similarly outlined below. The heterodimeric bispecific antibodies provided generally rely on the use of engineered or variant Fc domains that can self-assemble in production cells to produce heterodimeric proteins, and methods to generate and purify such heterodimeric proteins.

II. Nomenclature

The antibodies provided herein are listed in several different formats. In some instances, each monomer of a particular antibody is given a unique "XENP" number, although as will be appreciated in the art, a longer sequence might contain a shorter one. For example, a "scFv-Fc" monomer of a 1+1 Fab-scFv-Fc format antibody may have a first XENP number, while the scFv domain itself will have a different XENP number. Some molecules have three polypeptides, so the XENP number, with the components, is used as a name. Thus, the molecule XENP34389, which is in 2+1 $Fab_2$-scFv-Fc format, comprises three sequences (see FIG. 28A) a "Fab-Fc Heavy Chain" monomer; 2) a "Fab-scFv-Fc Heavy Chain" monomer; and 3) a "Light Chain" monomer or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab includes the full heavy chain sequence, the variable heavy domain sequence and the three CDRs of the variable heavy domain sequence, the full light chain sequence, a variable light domain sequence and the three CDRs of the variable light domain sequence. A Fab-scFv-Fc monomer includes a full-length sequence, a variable heavy domain sequence, 3 heavy CDR sequences, and an scFv sequence (include scFv variable heavy domain sequence, scFv variable light domain sequence and scFv linker). Note that some molecules herein with a scFv domain use a single charged scFv linker (+H), although others can be used. In addition, the naming nomenclature of particular antigen binding domains (e.g., B7H3 and CD28 binding domains) use a "Hx.xx_Ly.yy" type of format, with the numbers being unique identifiers to particular variable chain sequences. Thus, the variable domain of the Fab side of B7H3 binding domain 6A[B7H3](e.g., FIG. 28A) is "H1_L1", which indicates that the variable heavy domain, H1, was combined with the light domain L1. In the case that these sequences are used as scFvs, the designation "H1_L1", indicates that the variable heavy domain, H1 is combined with the light domain, L1, and is in VH-linker-VL orientation, from N- to C-terminus. This molecule with the identical sequences of the heavy and light variable domains but in the reverse order (VL-linker-VH orientation, from N- to C-terminus) would be designated "L1_H1". Similarly, different constructs may "mix and match" the heavy and light chains as will be evident from the sequence listing and the figures.

Additionally, with regard to the sequence listing, SEQ ID NOs:1 to 88 correspond to antigen binding domains previously shown in FIG. 17 of U.S. Ser. No. 63/092,272; SEQ ID NOs: 89-496 correspond to antigen binding domains previously shown in FIG. 24 of U.S. Ser. No. 63/092,272. Additionally, SEQ ID NOs: 497 to 584 are all variant variable heavy domains of the 2E4A3.189[B7H3] parental antibody, all of which find use in the present invention as more fully outlined below. SEQ ID NOs:585 to 651 are all variant variable heavy domains of the 1A7[CD28] parental antibody, all of which find use in the present invention. SEQ ID NOs:652 to 756 are all variant variable light domains of the 1A7[CD28] parental antibody, all of which find use in the present invention.

III. Definitions

In order that the application may be more completely understood, several definitions are set forth below. Such definitions are meant to encompass grammatical equivalents.

By "CD28," "Cluster of Differentiation 28," and "Tp44" (e.g., Genebank Accession Numbers NP_001230006 (human), NP_001230007 (human), NP_006130 (human), and NP_031668 (mouse)) herein is meant a B7 receptor expressed on T cells that provides co-stimulatory signals required for T cell activation and survival. T cell stimulation through CD28 in addition to the T cell receptor (TCR) provides a potent signal for the production of various interleukins. CD28 is the receptor for CD80 (B7.1) and CD86 (B7.2) proteins. CD28 includes an intercellular domain with a YMNM motif critical for the recruitment of SH2-domain containing proteins, particularly PI3K. CD28 also includes two proline-rich motifs that are able to bind SH3-containing proteins. Exemplary CD28 sequences are depicted in FIG. 1. Unless otherwise noted, references to CD28 are to the human CD28 sequence.

By "B7H3," "B7-H3," "B7RP-2," "CD276," "Cluster of Differentiation 276," (e.g., Genebank Accession Numbers NP_001019907 (human), NP_001316557 (human), NP_001316558 (human), NP_079516 (human), and NP_598744 (mouse)) herein is meant a type-1 transmembrane protein that is a member of the B7 family possessing an ectodomain composed of a single IgV-IgC domain pair. B7H3 is an immune checkpoint molecule and is aberrantly overexpressed in many types of cancers. Exemplary B7H3 sequences are depicted in FIGS. 2A and B. Unless otherwise noted, references to B7H3 are to the human B7H3 sequence.

Figure 5:
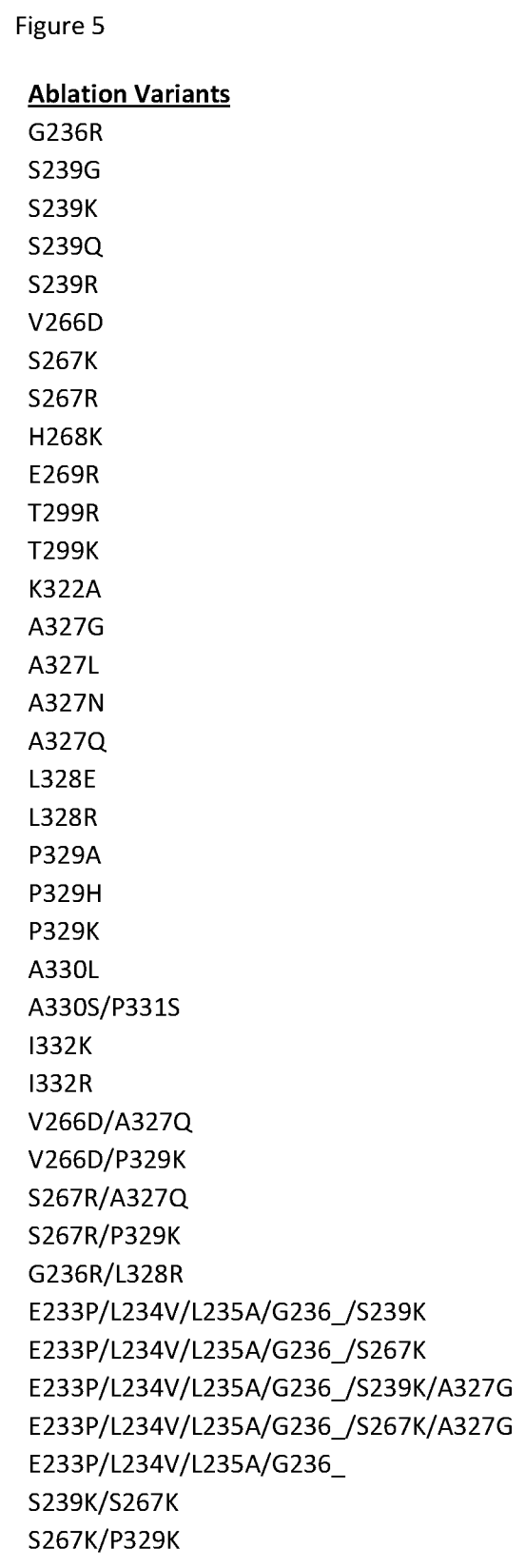

By "ablation" herein is meant a decrease or removal of activity. Thus, for example, "ablating FcγR binding" means the Fc region amino acid variant has less than 50% starting binding as compared to an Fc region not containing the specific variant, with more than 70-80-90-95-98% loss of activity being preferred, and in general, with the activity being below the level of detectable binding in a Biacore, SPR or BLI assay. Of particular use in the ablation of FcγR binding are those shown in FIG. 5, which generally are added to both monomers.

By "ADCC" or "antibody dependent cell-mediated cytotoxicity" as used herein is meant the cell-mediated reaction, wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific phagocytic cells that express FcγRs recognize bound antibody on a target cell and subsequently cause phagocytosis of the target cell.

As used herein, the term "antibody" is used generally. Antibodies provided herein can take on a number of formats as described herein, including traditional antibodies as well as antibody derivatives, fragments and mimetics, described herein.

Traditional immunoglobulin (Ig) antibodies are "Y" shaped tetramers. Each tetramer is typically composed of two identical pairs of polypeptide chains, each pair having one "light chain" monomer (typically having a molecular weight of about 25 kDa) and one "heavy chain" monomer (typically having a molecular weight of about 50-70 kDa).

Other useful antibody formats include, but are not limited to, the "1+1 Fab-scFv-Fc," "2+1 $Fab_2$-scFv-Fc," "1+1 common light chain," and "2+1 common light chain" formats provided herein (see, e.g., FIG. 33). Additional useful antibody formats include, but are not limited to, "mAb-Fv," "mAb-scFv," "central-Fv", "one armed scFv-mAb," "scFv-mAb," "dual scFv," and "trident" format antibodies, as disclosed in US20180127501A1, which is incorporated by reference herein, particularly in pertinent part relating to antibody formats (see, e.g., FIG. 2 of US20180127501A1).

Antibody heavy chains typically include a variable heavy (VH) domain, which includes vhCDR1-3, and an Fc domain, which includes a CH2-CH3 monomer. In some embodiments, antibody heavy chains include a hinge and CH1 domain. Traditional antibody heavy chains are monomers that are organized, from N- to C-terminus: VH-CH1-hinge-CH2-CH3. The CH1-hinge-CH2-CH3 is collectively referred to as the heavy chain "constant domain" or "constant region" of the antibody, of which there are five different categories or "isotypes": IgA, IgD, IgG, IgE and IgM.

In some embodiments, the antibodies provided herein include IgG isotype constant domains, which has several subclasses, including, but not limited to IgG1, IgG2, IgG3, and IgG4. In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-215 according to the EU index as in Kabat. "Hinge" refers to positions 216-230 according to the EU index as in Kabat. "CH2" refers to positions 231-340 according to the EU index as in Kabat, and "CH3" refers to positions 341-447 according to the EU index as in Kabat. As shown in Table 1, the exact numbering and placement of the heavy chain domains can be different among different numbering systems. As shown herein and described below, the pI variants can be in one or more of the CH regions, as well as the hinge region, discussed below.

It should be noted that IgG1 has different allotypes with polymorphisms at 356 (D or E) and 358 (L or M). The sequences depicted herein use the 356E/358M allotype, however the other allotype is included herein. That is, any sequence inclusive of an IgG1 Fc domain included herein can have 356D/358L replacing the 356E/358M allotype. It should be understood that therapeutic antibodies can also comprise hybrids of isotypes and/or subclasses. For example, as shown in US Publication 2009/0163699, incorporated by reference, the present antibodies, in some embodiments, include human IgGl/G2 hybrids.

By "Fc" or "Fc region" or "Fc domain" as used herein is meant the polypeptide comprising the constant region of an antibody, in some instances, excluding all of the first constant region immunoglobulin domain (e.g., CH1) or a portion thereof, and in some cases, optionally including all or part of the hinge. For IgG, the Fc domain comprises immunoglobulin domains CH2 and CH3 (Cγ2 and Cγ3), and optionally all or a portion of the hinge region between CH1 (Cγ1) and CH2 (Cγ2). Thus, in some cases, the Fc domain includes, from N- to C-terminal, CH2-CH3 and hinge-CH2-CH3. In some embodiments, the Fc domain is that from IgG1, IgG2, IgG3 or IgG4, with IgG1 hinge-CH2-CH3 and IgG4 hinge-CH2-CH3 finding particular use in many embodiments. Additionally, in the case of human IgG1 Fc domains, the hinge may include a C220S amino acid substitution. Furthermore, in the case of human IgG4 Fc domains, the hinge may include a S228P amino acid substitution. Although the boundaries of the Fc region may vary, the human IgG heavy chain Fc region is usually defined to include residues E216, C226, or A231 to its carboxyl-terminal, wherein the numbering is according to the EU index as in Kabat. In some embodiments, as is more fully described below, amino acid modifications are made to the Fc region, for example to alter binding to one or more FcγR or to the FcRn.

By "heavy chain constant region" herein is meant the CH1-hinge-CH2-CH3 portion of an antibody (or fragments thereof), excluding the variable heavy domain; in EU numbering of human IgG1 this is amino acids 118-447. By "heavy chain constant region fragment" herein is meant a heavy chain constant region that contains fewer amino acids from either or both of the N- and C-termini but still retains the ability to form a dimer with another heavy chain constant region.

Another type of domain of the heavy chain is the hinge region. By "hinge" or "hinge region" or "antibody hinge region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (P230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well. Many of the antibodies herein have at least one the cysteines at position 220 according to EU numbering (hinge region) replaced by a serine. Generally, this modification is on the "scFv monomer" side (when 1+1 or 2+1 formats are used) for most of the sequences depicted herein, although it can also be on the "Fab monomer" side, or both, to reduce disulfide formation. Specifically included within the sequences herein are one or both of these cysteines replaced (C220S).

As will be appreciated by those in the art, the exact numbering and placement of the heavy chain constant region domains (i.e., CH1, hinge, CH2 and CH3 domains) can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

| | EU Numbering | Kabat Numbering |
|---|---|---|
| CH1 | 118-215 | 114-223 |
| Hinge | 216-230 | 226-243 |
| CH2 | 231-340 | 244-360 |
| CH3 | 341-447 | 361-478 |

The antibody light chain generally comprises two domains: the variable light domain (VL), which includes light chain CDRs vlCDR1-3, and a constant light chain region (often referred to as CL or Cκ). The antibody light chain is typically organized from N- to C-terminus: VL-CL.

By "antigen binding domain" or "ABD" herein is meant a set of six Complementary Determining Regions (CDRs) that, when present as part of a polypeptide sequence, specifically binds a target antigen (e.g., B7H3 or CD28) as discussed herein. As is known in the art, these CDRs are generally present as a first set of variable heavy CDRs (vhCDRs or VHCDRs) and a second set of variable light CDRs (vlCDRs or VLCDRs), each comprising three CDRs: vhCDR1, vhCDR2, vhCDR3 variable heavy CDRs and vlCDR1, vlCDR2 and vlCDR3 vhCDR3 variable light CDRs. The CDRs are present in the variable heavy domain (vhCDR1-3) and variable light domain (vlCDR1-3). The variable heavy domain and variable light domain from an Fv region.

The present invention provides a large number of different CDR sets. In this case, a "full CDR set" comprises the three variable light and three variable heavy CDRs, e.g., a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g., vhCDR1, vhCDR2 and vhCDR3) and the disclosure of each variable light region is a disclosure of the vlCDRs (e.g., vlCDR1, vlCDR2 and vlCDR3). A useful comparison of CDR numbering is as below, see Lafranc et al., *Dev. Comp. Immunol.* 27(1):55-77 (2003):

TABLE 2

| | Kabat + Chothia | IMGT | Kabat | AbM | Chothia | Contact | Xencor |
|---|---|---|---|---|---|---|---|
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

The CDRs contribute to the formation of the antigen-binding, or more specifically, epitope binding site of the antigen binding domains and antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

In some embodiments, the six CDRs of the antigen binding domain are contributed by a variable heavy and a variable light domain. In a "Fab" format, the set of 6 CDRs are contributed by two different polypeptide sequences, the variable heavy domain (vh or VH; containing the vhCDR1, vhCDR2 and vhCDR3) and the variable light domain (vl or VL; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker (a "scFv linker") as outlined herein, into a single polypeptide sequence, which can be either (starting from the N-terminus) vh-linker-vl or v1-linker-vh, with the former being generally preferred (including optional domain linkers on each side, depending on the format used. In general, the C-terminus of the scFv domain is attached to the N-terminus of all or part of the hingein the second monomer.

By "variable region" or "variable domain" as used herein is meant the region of an immunoglobulin that comprises one or more Ig domains substantially encoded by any of the Vx, VW, and/or VH genes that make up the kappa, lambda, and heavy chain immunoglobulin genetic loci respectively, and contains the CDRs that confer antigen specificity. Thus, a "variable heavy domain" pairs with a "variable light domain" to form an antigen binding domain ("ABD"). In addition, each variable domain comprises three hypervariable regions ("complementary determining regions," "CDRs") (vhCDR1, vhCDR2 and vhCDR3 for the variable heavy domain and vlCDR1, vlCDR2 and vlCDR3 for the variable light domain) and four framework (FR) regions, arranged from amino-terminus to carboxy-terminus in the following order: FR1-CDR1-FR2-CDR2-FR3-CDR3-FR4.

By "Fab" or "Fab region" as used herein is meant the antibody region that comprises the VH, CH1, VL, and CL immunoglobulin domains, generally on two different polypeptide chains (e.g., VH-CH1 on one chain and VL-CL on the other). Fab may refer to this region in isolation, or this region in the context of a bispecific antibody of the invention. In the context of a Fab, the Fab comprises an Fv region in addition to the CH1 and CL domains.

By "Fv" or "Fv fragment" or "Fv region" as used herein is meant the antibody region that comprises the VL and VH domains. Fv regions can be formatted as both Fabs (as discussed above, generally two different polypeptides that also include the constant regions as outlined above) and single chain Fvs (scFvs), where the vl and vh domains are included in a single peptide, attached generally with a linker as discussed herein.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or v1-linker-vh). In the sequences depicted in the sequence listing and in the figures, the order of the vh and vl domain is indicated in the name, e.g., H.X_L.Y means N- to C-terminal is vh-linker-v1, and L.Y_H.X is v1-linker-vh.

Some embodiments of the subject antibodies provided herein comprise at least one scFv domain, which, while not naturally occurring, generally includes a variable heavy domain and a variable light domain, linked together by a scFv linker. As outlined herein, while the scFv domain is generally from N- to C-terminus oriented as VH-scFv linker-VL, this can be reversed for any of the scFv domains (or those constructed using vh and vl sequences from Fabs), to VL-scFv linker-VH, with optional linkers at one or both ends depending on the format.

By "modification" or "variant" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution;" that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, −233E or 233E designates an insertion of glutamic acid after position 233 and before position 234. Additionally, −233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233− or E233 #, E233( ) or E233del designates a deletion of glutamic acid at position 233. Additionally, EDA233− or EDA233 #designates a deletion of the sequence GluAspAla that begins at position 233.

By "variant protein" or "protein variant", or "variant" as used herein is meant a protein that differs from that of a parent protein by virtue of at least one amino acid modification. The protein variant has at least one amino acid modification compared to the parent protein, yet not so many that the variant protein will not align with the parental protein using an alignment program such as that described below. In general, variant proteins (such as variant Fc domains, etc., outlined herein, are generally at least 75, 80, 85, 90, 91, 92, 93, 94, 95, 96, 97, 98 or 99% identical to the parent protein, using the alignment programs described below, such as BLAST.

"Variant" as used herein also refers to particular amino acid modifications that confer particular function (e.g., a "heterodimerization variant," "pI variant," "ablation variant," etc.).

As described below, in some embodiments the parent polypeptide, for example an Fc parent polypeptide, is a human wild type sequence, such as the heavy constant domain or Fc region from IgG1, IgG2, IgG3 or IgG4, although human sequences with variants can also serve as "parent polypeptides", for example the IgG1/2 hybrid of US Publication 2006/0134105 can be included. The protein variant sequence herein will preferably possess at least about 80% identity with a parent protein sequence, and most preferably at least about 90% identity, more preferably at least about 95-98-99% identity. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain as compared to an Fc domain of human IgG1, IgG2 or IgG4.

"Fc variant" or "variant Fc" as used herein is meant a protein comprising an amino acid modification in an Fc domain. The modification can be an addition, deletion, or substitution. The Fc variants are defined according to the amino acid modifications that compose them. Thus, for example, N434S or 434S is an Fc variant with the substitution for serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/4345. It is noted that the order in which substitutions are provided is arbitrary, that is to say that, for example, 428L/4345 is the same Fc variant as 4345/428L, and so on. For all positions discussed herein that relate to antibodies or derivatives and fragments thereof (e.g., Fc domains), unless otherwise noted, amino acid position numbering is according to the EU index. The "EU index" or "EU index as in Kabat" or "EU numbering" scheme refers to the numbering of the EU antibody (Edelman et al., 1969, Proc Natl Acad Sci USA 63:78-85, hereby entirely incorporated by reference). The modification can be an addition, deletion, or substitution.

In general, variant Fc domains have at least about 80, 85, 90, 95, 97, 98 or 99 percent identity to the corresponding parental human IgG Fc domain (using the identity algorithms discussed below, with one embodiment utilizing the BLAST algorithm as is known in the art, using default parameters). Alternatively, the variant Fc domains can have from 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Alternatively, the variant Fc domains can have up to 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Additionally, as discussed herein, the variant Fc domains described herein still retain the ability to form a dimer with another Fc domain as measured using known techniques as described herein, such as non-denaturing gel electrophoresis.

By "protein" as used herein is meant at least two covalently attached amino acids, which includes proteins, polypeptides, oligopeptides and peptides. In addition, polypeptides that make up the antibodies of the invention may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the human IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life. An "FcRn variant" is an amino acid modification that contributes to increased binding to the FcRn receptor, and suitable FcRn variants are shown below.

By "parent polypeptide" as used herein is meant a starting polypeptide that is subsequently modified to generate a variant. The parent polypeptide may be a naturally occurring polypeptide, or a variant or engineered version of a naturally occurring polypeptide. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below. In this context, a "parent Fc domain" will be relative to the recited variant; thus, a "variant human IgG1 Fc domain" is compared to the parent Fc domain of human IgG1, a "variant human IgG4 Fc domain" is compared to the parent Fc domain human IgG4, etc.

By "position" as used herein is meant a location in the sequence of a protein. Positions may be numbered sequentially, or according to an established format, for example the EU index for numbering of antibody domains (e.g., a CH1, CH2, CH3 or hinge domain).

By "target antigen" as used herein is meant the molecule that is bound specifically by the antigen binding domain comprising the variable regions of a given antibody.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g., making the pI higher) then steric variants that are "charge pairs" that can be utilized as well do not interfere with the pI variants, e.g., the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer one set of the pair will go, such that pI separation is maximized using the pI of the skews as well.

By "target cell" as used herein is meant a cell that expresses a target antigen.

By "host cell" in the context of producing a bispecific antibody according to the invention herein is meant a cell that contains the exogeneous nucleic acids encoding the components of the bispecific antibody and is capable of expressing the bispecific antibody under suitable conditions. Suitable host cells are discussed below.

By "wild type" or "WT" herein is meant an amino acid sequence or a nucleotide sequence that is found in nature, including allelic variations. A WT protein has an amino acid sequence or a nucleotide sequence that has not been intentionally modified.

Provided herein are a number of antibody domains (e.g., Fc domains) that have sequence identity to human antibody domains. Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, CD. (1970) "A General Method Applicable To The Search For Similarities In The Amino Acid Sequence Of Two Proteins," J. Mol. Biol. 48:443 [homology alignment algorithm], Pearson, W.R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see https://blast.ncbi.nlm.nih.gov/Blast.cgi. When using any of the aforementioned algorithms, the default parameters (for Window length, gap penalty, etc) are used. In one embodiment, sequence identity is done using the BLAST algorithm, using default parameters The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogeneous host cells, and they can be isolated as well. [00273]"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore, SPR or BLI assay.

IV. CD28 and B7H3 Antigen Binding Domains

Provided herein are antigen binding domains (ABDs) and ABD compositions that bind either B7H3 or CD28. In some embodiments, one or more of the ABDs are included in an antibody format described herein including, for example, "1+1 Fab-scFv-Fc," "2+1 $Fab_2$-scFv-Fc," "1+1 common light chain," and "2+1 common light chain" antibodies.

A. CD28 Antigen Binding Domains and Antibodies

In one aspect, provided herein are CD28 antigen binding domains (ABDs) that bind human CD28, and compositions that include such CD28 antigen binding domains (e.g., antibodies, including the heterodimeric antibodies provided herein). In some embodiments, the CD28 antigen binding domain described herein are agonistic CD28 ABDs that advantageously provide costimulatory activity. Thus, such CD28 ABDs provided herein are useful of enhancing immune responses, for example, when used as a monotherapy or in combination with other therapeutics (e.g., anti-cancer therapeutics for the treatment of particular cancers).

As will be appreciated by those in the art, suitable CD28 binding domains can comprise a set of 6 CDRs as depicted in the Sequence Listing and figures, either as they are underlined or, in the case where a different numbering scheme is used as described herein and as shown in Table 2, as the CDRs that are identified using other alignments within the variable heavy (VH) domain and variable light domain (VL) sequences of those depicted in FIGS. 18-21 and 23 and the Sequence Listing. Suitable CD28 ABDs can also include the entire VH and VL sequences as depicted in these sequences and figures, used as scFvs or as Fabs.

In one embodiment, the CD28 antigen binding domain includes the 6 CDRs (i.e., vhCDR1-3 and vlCDR1-3) of any of the CD28 binding domains described herein, including the figures and sequence listing. In some embodiments, the CD28 ABD that binds human CD28 is one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1 (FIGS. 18-21 and 23 and the Sequence Listing). In exemplary embodiments, the CD28 ABD is CD28 ABDs: 1A7[CD28]_H1L1 or 1A7[CD28]_H1.14L1.

In addition to the parental CDR sets disclosed in the figures and sequence listing that form an ABD to CD28, provided herein are variant CD28 ABDS having CDRs that include at least one modification of the CD28 ABD CDRs disclosed herein (e.g., FIGS. 18-21 and 23 and the Sequence Listing). In one embodiment, the CD28 ABD includes a set of 6 CDRs with 1, 2, 3, 4, 5, 6, 7, 8, 9, 10 amino acid modifications as compared to the 6 CDRs of a CD28 ABD as described herein, including the figures and sequence listing. In exemplary embodiments, the CD28 ABD includes a set of 6 CDRs with 1, 2, 3, 4, 5, 6, 7, 8, 9, 10 amino acid modifications as compared to the 6 CDRs of one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and the Sequence Listing). In exemplary embodiments, the CD28 ABD is CD28 ABDs: 1A7[CD28]_H1L1 or 1A7[CD28]_H1.14L1.

In certain embodiments, the CD28 ABD is capable of binding CD28 antigen, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1).

In some embodiments, the CD28 ABD includes 6 CDRs that are at least 90, 95, 97, 98 or 99% identical to the 6 CDRs of a CD28 ABD as described herein, including the figures and sequence listing. In exemplary embodiments, the CD28 ABD includes 6 CDRs that are at least 90, 95, 97, 98 or 99% identical to the 6 CDRs of one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and the Sequence Listing). In certain embodiments, the CD28 ABD is capable of binding to the CD28, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1).

In another exemplary embodiment, the CD28 ABD include the variable heavy (VH) domain and variable light (VL) domain of any one of the CD28 ABDs described herein, including the figures and sequence listing. In exemplary embodiments, the CD28 ABD is one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and the Sequence Listing).

In addition to the parental CD28 variable heavy and variable light domains disclosed herein, provided herein are CD28 ABDs that include a variable heavy domain and/or a variable light domain that are variants of a CD28 ABD VH and VL domain disclosed herein. In one embodiment, the variant VH domain and/or VL domain has from 1, 2, 3, 4, 5, 6, 7, 8, 9 or 10 amino acid changes from a VH and/or VL domain of a CD28 ABD described herein, including the figures and sequence listing. In exemplary embodiments, the variant VH domain and/or VL domain has from 1, 2, 3, 4, 5, 6, 7, 8, 9 or 10 amino acid changes from a VH and/or VL domain of one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and the Sequence Listing). In certain embodiments, the CD28 ABD is capable of binding to CD28, as measured at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1).

In one embodiment, the variant VH and/or VL domain is at least 90, 95, 97, 98 or 99% identical to the VH and/or VL of a CD28 ABD as described herein, including the figures and sequence listing. In exemplary embodiments, the variant VH and/or VL domain is at least 90, 95, 97, 98 or 99% identical to the VH and/or VL of one of the following CD28 ABDs: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and the Sequence Listing). In certain embodiments, the CD28 ABD is capable of binding to CD28, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1).

In one embodiment, the CD28 antigen binding domain includes a variable heavy domain (VH) having the vhCDR1-3 (i.e., vhCDR1-3) of 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding CD28 antigen, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1).

Such CD28 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In one embodiment, the CD28 ABD includes a variable heavy domain (VH) having vhCDR1-3s with 1, 2, 3, 4, 5, 6, 7, 8, 9, 10 amino acid modifications as compared to the vhCDR1-3 of 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding CD28 antigen, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In some embodiments, the CD28 ABD includes a variable heavy domain (VH) having vhCDR1-3s that are at least 90, 95, 97, 98 or 99% identical to the 6 vhCDR1-3 of 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding to the CD28, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In another exemplary embodiment, the CD28 ABD include the variable heavy (VH) domain 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding to the CD28, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In addition to the parental CD28 variable heavy domains disclosed herein, provided herein are CD28 ABDs that include a variable heavy domain that is a variant of 1A7_H1.14 (FIG. 16). In one embodiment, the variant VH domain has from 1, 2, 3, 4, 5, 6, 7, 8, 9 or 10 amino acid changes from 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding to CD28, as measured at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In one embodiment, the variant VH domain is at least 90, 95, 97, 98 or 99% identical to 1A7_H1.14 (FIG. 19). In some embodiments, the CD28 antigen binding domain further includes any of the CD28 binding domain variable light domains provided herein. In exemplary embodiments, the variable light domain is 1A7_L1 (FIG. 18) or a variant thereof. In certain embodiments, the CD28 ABD is capable of binding to CD28, as measured by at least one of a Biacore, surface plasmon resonance (SPR) and/or BLI (biolayer interferometry, e.g., Octet assay) assay, with the latter finding particular use in many embodiments. In particular embodiments, the CD28 ABD is capable of binding human CD28 antigen (see FIG. 1). Such CD28 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

Specific anti-CD28 ABDs of interest include a VH domain with an amino acid sequence selected from the group consisting of SEQ ID NO:870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO: 1198 and SEQ ID NO: 1199, paired with a VL domain of SEQ ID NO:874.

In other cases, the anti-CD28 VH domain has an amino acid sequence selected from SEQ ID NO:870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO: 1198 and SEQ ID NO:1199, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some cases, the anti-CD28 binding domain has a VH domain and VL domain with amino acid sequences selected from the pairs of a) SEQ ID NOs:1 and 5, b) SEQ ID NOs: 9 and 13, c) SEQ ID NOs:17 and 21, d) SEQ ID NOs:25 and 29, e) SEQ ID NOs:33 and 37, f) SEQ ID NOs:41 and 45; g) SEQ ID NOs:49 and 53, h) SEQ ID NOs:57 and 61, i) SEQ ID NOs:65 and 69, j) SEQ ID NOs:73 and 77, and k) SEQ ID NOs:81 and 85.

B. B7H3 Antigen Binding Domains

In one aspect, provided herein are B7H3 antigen binding domains (ABDs) and compositions that include such B7H3 antigen binding domains (ABDs), including anti-B7H3 antibodies. Such B7H3 binding domains and related antibodies (e.g., anti-B7H3 x anti-CD28 bispecific antibodies) find use, for example, in the treatment of B7H3 associated cancers.

As will be appreciated by those in the art, suitable B7H3 binding domains can comprise a set of 6 CDRs as depicted in the Sequence Listing and FIGS. 26-31, either as the CDRs are underlined or, in the case where a different numbering scheme is used as described herein and as shown in Table 2, as the CDRs that are identified using other alignments within the variable heavy (VH) domain and variable light domain (VL) sequences of those depicted in FIGS. 26-31 and the Sequence Listing (see Table 2). Suitable B7H3 ABDs can also include the entire VH and VL sequences as depicted in these sequences and figures, used as scFvs or as Fab domains.

In one embodiment, the B7H3 antigen binding domain includes the 6 CDRs (i.e., vhCDR1-3 and vlCDR1-3) of a B7H3 ABD described herein, including the figures and sequence listing. In exemplary embodiments, the B7H3 ABD is one of the following B7H3 ABDs: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing).

In addition to the parental CDR sets disclosed in the figures and sequence listing that form an ABD to B7H3, provided herein are variant B7H3 ABDS having CDRs that include at least one modification of the B7H3 ABD CDRs disclosed herein. In one embodiment, the B7H3 ABD includes a set of 6 CDRs with 1, 2, 3, 4, 5, 6, 7, 8, 9, 10 amino acid modifications as compared to the 6 CDRs of a B7H3 ABD described herein, including the figures and sequence listing. In exemplary embodiments, the B7H3 ABD includes a set of 6 CDRs with 1, 2, 3, 4, 5, 6, 7, 8, 9, 10 amino acid modifications as compared to the 6 CDRs of one of the following B7H3 ABDs: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In certain embodiments, the variant B7H3 ABD is capable of binding B7H3 antigen, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2).

In one embodiment, the B7H3 ABD includes 6 CDRs that are at least 90, 95, 97, 98 or 99% identical to the 6 CDRs of a B7H3 ABD as described herein, including the figures and sequence listing. In exemplary embodiments, the B7H3 ABD includes 6 CDRs that are at least 90, 95, 97, 98 or 99% identical to the 6 CDRs of one of the following B7H3 ABDs: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In certain embodiments, the B7H3 ABD is capable of binding to B7H3 antigen, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2).

In another exemplary embodiment, the B7H3 ABD include the variable heavy (VH) domain and variable light (VL) domain of any one of the B7H3 ABDs described herein, including the figures and sequence listing. In exemplary embodiments, the B7H3 ABD is one of the following B7H3 ABDs: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1/1A7[CD28]_L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In exemplary embodiments, the B7H3 ABD is one of the following: B7H3 ABDs: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1/1A7[CD28]_L1, 2E4A3.189[B7H3]_H1.22/1A7[CD28]_L1, or 6A1[B7H3]_ H1L1.

In addition to the parental B7H3 variable heavy and variable light domains disclosed herein, provided herein are B7H3 ABDs that include a variable heavy domain and/or a variable light domain that are variants of a B7H3 ABD VH and VL domain disclosed herein. In one embodiment, the variant VH domain and/or VL domain has from 1, 2, 3, 4, 5, 6, 7, 8, 9 or 10 amino acid changes from a VH and/or VL domain of a B7H3 ABD described herein, including the figures and sequence listing. In exemplary embodiments, the variant VH domain and/or VL domain has from 1, 2, 3, 4, 5, 6, 7, 8, 9 or 10 amino acid changes from a VH and/or VL domain of one of the following B7H3 ABDs: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In certain embodiments, the B7H3 ABD is capable of binding to B7H3, as measured at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2).

In one embodiment, the variant VH and/or VL domain is at least 90, 95, 97, 98 or 99% identical to the VH and/or VL of a B7H3 ABD as described herein, including the figures and sequence listing. In exemplary embodiments, the variant VH and/or VL domain is at least 90, 95, 97, 98 or 99% identical to the VH and/or VL of one of the following B7H3 ABDs: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In certain embodiments, the B7H3 ABD is capable of binding to the B7H3, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2).

In one embodiment, the B7H3 antigen binding domain includes a variable heavy domain (VH) having the vhCDR1-3 (i.e., vhCDR1-3) of 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding B7H3 antigen, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2). Such B7H3 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In one embodiment, the B7H3 ABD includes a variable heavy domain (VH) having vhCDR1-3s with 1, 2, 3, 4, 5, 6, 7, 8, 9, 10 amino acid modifications as compared to the vhCDR1-3 of 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding B7H3 antigen, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2). Such B7H3 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In some embodiments, the B7H3 ABD includes a variable heavy domain (VH) having vhCDR1-3s that are at least 90, 95, 97, 98 or 99% identical to the 6 vhCDR1-3 of 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding to the B7H3, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2). Such B7H3 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In another exemplary embodiment, the B7H3 ABD include the variable heavy (VH) domain 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding to the B7H3, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 1). Such B7H3 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In addition to the parental B7H3 variable heavy domains disclosed herein, provided herein are B7H3 ABDs that include a variable heavy domain that is a variant of the variable heavy (VH) domain 2E4A3.189_H1.22 (FIG. 27). In one embodiment, the variant VH domain has from 1, 2, 3, 4, 5, 6, 7, 8, 9 or 10 amino acid changes from the variable heavy (VH) domain 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding to B7H3, as measured at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2). Such B7H3 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In one embodiment, the variant VH domain is at least 90, 95, 97, 98 or 99% identical to 2E4A3.189_H1.22 (FIG. 27). In some embodiments, the B7H3 antigen binding domain further includes any of the B7H3 or CD28 binding domain variable light domains provided herein. In exemplary embodiments, the variable light domain is 2E4A3.189_L1 (FIG. 26), 1A7_L1 (FIG. 18) or a variant thereof. In certain embodiments, the B7H3 ABD is capable of binding to B7H3, as measured by at least one of a Biacore, surface plasmon resonance (SPR) and/or BLI (biolayer interferometry, e.g., Octet assay) assay, with the latter finding particular use in many embodiments. In particular embodiments, the B7H3 ABD is capable of binding human B7H3 antigen (see FIG. 2). Such B7H3 binding domains can be included in any of the antibodies provided herein including, for example, "1+1 Fab-scFv-Fc," "2+1 $Fab_2$-scFv-Fc," "1+1 common light chain," and "2+1 common light chain" antibodies.

In some embodiments, the anti-B7H3 ABD has a VH domain and VL domain with amino acid sequences selected from the pairs of a) SEQ ID NOs: 89 and 93 from omburamab, b) SEQ ID NOs:97 and 101 from enoblituzumab, c) SEQ ID NOs:105 and 109 from BRCA84D, d) SEQ ID NOs:113 and 117 from BRCA69D, e) SEQ ID NOs:121 and 125 from PRCA157, f) SEQ ID NOs:129 and 133 from huPRCA157, g) SEQ ID NOs:137 and 141 from Mab-D; h) SEQ ID NOs:145 and 149 humAb-D; i) SEQ ID NOs:153 and 157 from m30; j) SEQ ID NOs:161 and 165 from M30-H1-L4, k) SEQ ID NOs:169 and 173 SP265; 1) SEQ ID NOs:177 and 181 from S10-H50L58; m) SEQ ID NOs:185 and 189 from 8H9, n) SEQ ID NOs:193 and 197 from m852; o) SEQ ID NOs:201 and 205 from m857; p) SEQ ID NOs:209 and 213 from m8524; q) SEQ ID NOs:217 and 221 from 1-1; r) SEQ ID NOs:225 and 229 from 1-2; s) SEQ ID NOs:233 and 237 from 1-4; t) SEQ ID NOs:241 and 245 from 1-5; u) SEQ ID NOs:249 and 253 from 1-7; v) SEQ ID NOs:257 and 261 from 2-5; w) SEQ ID NOs:265 and 269 from 2-8; x) SEQ ID NOs: 273 and 277 from chAb2; y) SEQ ID NOs:281 and 285 chAb3; z) SEQ ID NOs:289 and 293 from chAb4; aa) SEQ ID NOs:297 and 301 from chAb18; bb) SEQ ID NOs:305 and 309 from chAb13; cc) SEQ ID NOs:313 and 317 from chAb12; dd) SEQ ID NOs:321 and 325 from chAb14; ee) SEQ ID NOs:329 and 333 from chAb6; ff) SEQ ID NOs:337 and 341 from chAb11, gg) SEQ ID NOs:345 and 349 from chAB16; hh) SEQ ID NOs:353 and 357 from chAb10; ii) SEQ ID NOs:361 and 365 from ChAb7; jj) SEQ ID NOs: 369 and 373 from chAb8, kk) SEQ ID NOs:377 and 381 from chAb17; 11) SEQ ID NOs:385 and 389 from chAb5, mm) SEQ ID NOs:393 and 397 from huAb3v2.5, nn) SEQ ID NOs:401 and 405 from huAb3v2.6, pp) SEQ ID NOs:409 and 413 from huAb13v1, qq) SEQ ID NOs:417 and 421 from TPP-5706, rr) SEQ ID NOs:425 and 429 from TPP-6642; ss) SEQ ID NOs:433 and 437 from TPP-6850, tt) SEQ ID NOs:441 and 445 from TPP-3803, uu) SEQ ID NOs:449 and 453 from TRL4542, vv) SEQ ID NOs:457 and 461 from h1702, ww) SEQ ID NOs:465 and 469 from h1703, xx) SEQ ID NOs:473 and 477 from huA3, yy) SEQ ID NOs:481 and 485 from huA9 and zz) SEQ ID NOs: 489 and 493 from m1704. See FIG. 17 from U.S. Ser. No. 63/092,272.

In some embodiments, the anti-B7H3 ABD has an VH domain with the amino acid sequence of SEQ ID NO:942 (2E4A3.189_H1.22) and a VL domain with the amino acid sequence of SEQ ID NO:874 (1A7[CD28]L1, which is the common light chain for both B7H3 and CD28).

V. Antibodies

In one aspect provided herein are anti-CD28 antibodies and anti-B7H3 antibodies. Antibodies provided herein can include any of the B7H3 and/or CD28 binding domains provided herein (e.g., "1+1 Fab-scFv-Fc," "2+1 $Fab_2$-scFv-Fc," "1+1 common light chain," and "2+1 common light chain" antibodies).

The antibodies provided herein include different antibody domains. As described herein and known in the art, the antibodies described herein include different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2—CH3), the variable heavy domain, the variable light domain, the light constant domain, Fab domains and scFv domains.

As shown herein, there are a number of suitable linkers (for use as either domain linkers or scFv linkers) that can be used to covalently attach the recited domains (e.g., scFvs, Fabs, Fc domains, etc.), including traditional peptide bonds, generated by recombinant techniques. Exemplary linkers to attach domains of the subject antibody to each other are depicted in FIG. 7. In some embodiments, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n, (GGGGS)n, and (GGGS)n, where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example CK or Ck. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g., TCR, FcR, KIR), hinge region-derived sequences, and other natural sequences from other proteins.

In some embodiments, the linker is a "domain linker", used to link any two domains as outlined herein together. For example, in the 2+1 $Fab_2$-scFv-Fc format, there may be a domain linker that attaches the C-terminus of the CH1 domain of the Fab to the N-terminus of the scFv, with another optional domain linker attaching the C-terminus of the scFv to the CH2 domain (although in many embodiments the hinge is used as this domain linker). While any suitable linker can be used, many embodiments utilize a glycine-serine polymer as the domain linker, including for example (GS)n, (GSGGS)n, (GGGGS)n, and (GGGS)n, where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used. Exemplary useful domain linkers are depicted in FIG. 7.

In some embodiments, the linker is a scFv linker that is used to covalently attach the VH and VL domains as discussed herein. In many cases, the scFv linker is a charged scFv linker, a number of which are shown in FIG. 6. Accordingly, provided herein are charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make 1+1 Fab-scFv-Fc format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 6 can be used in any embodiment herein where a linker is utilized.

The B7H3 binding domains and CD28 binding domains provided can be included in any useful antibody format including, for example, canonical immunoglobulin, as well as the "1+1 Fab-scFv-Fc," "2+1 $Fab_2$-scFv-Fc," "1+1 common light chain," and "2+1 common light chain" formats provided herein (see, e.g., FIG. 25). Other useful antibody formats include, but are not limited to, "mAb-Fv," "mAb-scFv," "central-Fv", "one armed scFv-mAb," "scFv-mAb," "dual scFv," and "trident" format antibodies, as disclosed in US20180127501A1, which is incorporated by reference herein, particularly in pertinent part relating to antibody formats (see, e.g., FIG. 2).

In some embodiments, the subject antibody includes one or more of the B7H3 ABDs provided herein. In some embodiments, the antibody includes one B7H3 ABD. In other embodiments, the antibody includes two B7H3 ABDs. In exemplary embodiments, the B7H3 ABD includes the variable heavy domain and variable light domain of one of the following B7H3 ABDs: 2E4A3.189[B7H3]_H1L1, 2E4A3.189[B7H3]_H1/1A7[CD28]_L1, 2E4A3.189 [B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing). In some embodiments, the B7H3 ABD is one of the following B7H3 ABDs: 2E4A3.189[B7H3]_H1L1, 2E4A3.189[B7H3]_H1/1A7[CD28]_L1, 2E4A3.189 [B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing).

In an exemplary embodiment, the antibody is a bispecific antibody that includes one or two B7H3 ABDs, including any of the B7H3 ABDs provided herein.

Bispecific antibody that include such B7H3 ABDs include, for example, "1+1 Fab-scFv-Fc," "2+1 $Fab_2$-scFv-Fc," "1+1 common light chain," and "2+1 common light chain" bispecifics format antibodies (FIG. 25). In exemplary embodiments, the B7H3 ABD is one of the following B7H3 ABDs: 2E4A3.189[B7H3]_H1L1, 2E4A3.189[B7H3]_H1/1A7[CD28]_L1, 2E4A3.189[B7H3]_H1.22L1, 2E4A3.189 [B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing). In exemplary embodiments the B7H3 binding domains is a Fab. In some embodiments, such bispecific antibodies are heterodimeric bispecific antibodies that include any of the heterodimerization skew variants, pI variants and/or ablation variants described herein. See FIG. 8.

In some embodiments, the subject antibody includes one or more of the CD28 ABDs provided herein. In some embodiments, the antibody includes one CD28 ABD. In other embodiments, the antibody includes two CD28 ABDs. In exemplary embodiments, the antibody includes the variable heavy domain and variable light domain of one of the CD28 ABDs: 1A7[CD28]_H1L1, 1A7[CD28]_H1.14L1, 1A7[CD28]_H1_L1.71, 1A7[CD28]_H1.1_L1.71, 1A7 [CD28]_H1.14_L1.71, CD28.3[CD28]_H0L0, hCD28.3 [CD28]_H1L1, 5.11A1[CD28]_H0L0, TGN1412_H1L1, 341VL34[CD28]_H1L1, 341VL36[CD28]_H1L1, 281VL4 [CD28]_H1L1, HuTN228[CD28]_H1L1, PV1[CD28]_H0L0, m9.3[CD28]_H0L0, hu9.3[CD28]_H1L1 (FIGS. 18-21 and 23 and the Sequence Listing).

In an exemplary embodiment, the antibody is a bispecific antibody that includes one or two CD28 ABDs, including any of the CD28 ABDs provided herein. Bispecific antibody that include such CD28 ABDs include, for example, "1+1 Fab-scFv-Fc," "2+1 $Fab_2$-scFv-Fc," "1+1 common light chain," and "2+1 common light chain" bispecifics format antibodies (FIG. 25). In exemplary embodiments, the CD28 ABD is one of the following CD28 ABDs: 1A7[CD28]_H1L1, 1A7[CD28]_H1.14L1, 1A7[CD28]_H1_L1.71, 1A7 [CD28]_H1.1_L1.71, 1A7[CD28]_H1.14_L1.71, CD28.3 [CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228 [CD28]_H1L1, PV1[CD28]_H0L0, m9.3[CD28]_H0L0, hu9.3[CD28]_H1L1 (FIGS. 18-21 and 23 and the Sequence Listing). In exemplary embodiments, the CD28 ABD is an anti-CD28 scFv included in an "1+1 Fab-scFv-Fc," or "2+1 $Fab_2$-scFv-Fc bispecifics format antibodies (FIG. 25). In some embodiments, such bispecific antibodies are heterodimeric bispecific antibodies that include any of the heterodimerization skew variants, pI variants and/or ablation variants described herein. See FIG. 8.

A. Chimeric and Humanized Antibodies

In certain embodiments, the subject antibodies provided herein include a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody (using the methods outlined herein). A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention).

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

B. Anti-CD28 x Anti-Tumor Associated Antigen (TAA) Antibodies

In another aspect, provided herein are anti-CD28 x anti-TAA antibodies. In some embodiments, the anti-CD28 x anti-TAA antibody includes a CD28 binding and one or more binding domains that bind a tumor associated antigen. In some embodiments, the CD28 binding domain of the antibody is an agonistic CD28 binding domain that provides co-stimulatory function by binding to CD28 on T cells. As such, the anti-CD28 x anti-TAA antibody provided herein enhance immune responses selectively at tumor sites that express the particular TAA (e.g., B7H3). In some embodiments, the anti-CD28 x anti-TAA antibody is a bispecific antibody. In some embodiments, the anti-CD28 x anti-TAA antibody is a trispecific antibody. In some embodiments, the anti-CD28 x anti-TAA antibody is a bivalent antibody. In some embodiments, the anti-CD28 x anti-TAA antibody is a trivalent antibody. In some embodiments, the anti-CD28 x anti-TAA antibody is a bispecific, bivalent antibody. In exemplary embodiments, the anti-CD28 x anti-TAA antibody is a bispecific, trivalent antibody.

As is more fully outlined herein, the anti-CD28 x anti-TAA antibody can be in a variety of formats, as outlined below. Exemplary formats include the "1+1 Fab-scFv-Fc," "2+1 $Fab_2$-scFv-Fc," "1+1 common light chain," and "2+1 common light chain" formats provided herein (see, e.g., FIG. 25). Other useful antibody formats include, but are not limited to, "mAb-Fv," "mAb-scFv," "central-Fv", "one armed scFv-mAb," "scFv-mAb," "dual scFv," and "trident" format antibodies, as disclosed in US20180127501A1, which is incorporated by reference herein, particularly in pertinent part relating to antibody formats (see, e.g., FIG. 2).

The anti-CD28 x anti-TAA antibody can include any suitable CD28 ABD, including those described herein. In some embodiments, the CD28 ABD is an agonistic ABD that provides co-stimulatory function upon binding to CD28. In some embodiments, the anti-CD28 x anti-TAA antibody includes a CD28 binding domain that includes the variable heavy domain and variable light of one of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, and hu9.3[CD28]_H1L1 (FIGS. 18-21 and 23 and Sequence Listing) or variant thereof.

The anti-CD28 x anti-TAA antibody provided herein can include one or more TAA binding domains. In some embodiments, the anti-CD28 x anti-TAA antibody includes one TAA binding domain. In certain embodiments, the anti-CD28 x anti-TAA antibody includes two TAA binding domain. Any suitable TAA binding domain can be included in the subject anti-CD28 x anti-TAA antibody, depending on the tumor selected for targeting. TAAs that can be targeted by the anti-CD28 x anti-TAA antibodies provided herein include, but are not limited to: B7H, CD20, CD38, CD123; ROR1, ROR2, BCMA; PSMA; SSTR2; SSTR5, CD19, FLT3, CD33, PSCA, ADAM 17, CEA, Her2, EGFR, EGFR-vIII, CD30, FOLR1, GD-2, CA-IX, Trop-2, CD70, CD38, mesothelin, EphA2, CD22, CD79b, GPNMB, CD56, CD138, CD52, CD74, CD30, CD123, RON, ERBB2, and EGFR. Additional TAAs are described for example, in US20160355608 and US20170209492, which are incorporated herein in pertinent parts relating to tumor-associated antigens. Suitable TAA binding domains that can be included in the subject anti-CD28 x anti-TAA antibodies are disclosed, for example, US20190248898A1 (SSTR2), US20200165356A1 (FAP), US20170320947A1 (PSMA), which are all incorporated by reference in pertinent parts relating to TAA binding domains.

In certain embodiments, the anti-CD28 x anti-TAA antibody includes a B7H3 binding domain. In some embodiments, such anti-CD28 x anti-B7H3 (also referred to herein as "αB7H3 x αCD28" or as "αCD28 x αB7H3") bispecific antibodies include at least one B7H3 ABD and at least one CD28 binding domain. In exemplary embodiments, the anti-CD28 x anti-B7H3 bispecific antibody includes two B7H3 binding domains. In some embodiments, the CD28 binding domain of the bispecific antibody is an agonistic CD28 binding domain that provides co-stimulatory function by binding to CD28 on T cells. As such, the bispecific αB37H3 x αCD28 provided herein enhance immune responses selectively in tumor sites that express B7H3.

The anti-CD28 x anti-B7H3 bispecific antibody can include any suitable CD28 ABD and B7H3 ABD, including those described herein. In some embodiments, the anti-CD28 x anti-B7H3 bispecific antibody includes a CD28 binding domain that includes the variable heavy domain and variable light of one of the following CD28 binding domains: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, hCD28.3[CD28]_H1L1, 5.11A1[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1 (FIGS. 18-21 and 23 and Sequence Listing) or variant thereof. In some embodiments, the B7H3 ABD includes the variable heavy domain and variable light domain of one of the following B7H3 ABDs: 2E4A3.189[B7H3]_H1L1, 2E4A3.189[B7H3]_H1/1A7[CD28]_L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing) or variants thereof.

Note that unless specified herein, the order of the antigen list in the name does not confer structure; that is an anti-B7H3 x anti-CD28 1+1 Fab-scFv-Fc antibody can have the scFv bind to B7H3 or CD28, although in some cases, the order specifies structure as indicated.

In addition, in embodiments wherein the subject antibody includes an scFv, the scFv can be in an orientation from N- to C-terminus of VH-scFv linker-VL or VL-scFv linker-VH. In some formats, one or more of the ABDs generally is a Fab that includes a VH domain on one protein chain (generally as a component of a heavy chain) and a VL on another protein chain (generally as a component of a light chain).

As will be appreciated by those in the art, any set of 6 CDRs or VH and VL domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIG. 6.

In addition, as discussed above, the numbering used in the Sequence Listing for the identification of the CDRs is Kabat, however, different numbering can be used, which will change the amino acid sequences of the CDRs as shown in Table 2.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 or 90% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 or 90% identity to a human germline sequence selected from those listed in FIG. 1 of U.S. Pat. No. 7,657,380. Alternatively, the CDRs can have amino acid modifications (e.g., from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g., there may be one change in vlCDR1, two in vhCDR2, none in vhCDR3, etc.)), as well as having framework region changes, as long as the framework regions retain at least 80, 85 or 90% identity to a human germline sequence selected from those listed in FIG. 1 of U.S. Pat. No. 7,657,380.

C. Heterodimeric Antibodies

In exemplary embodiments, the anti-CD28 x anti-TAA (e.g., anti-CD28 x anti-B7H3) antibodies provided herein are heterodimeric bispecific antibodies that include two variant Fc domain sequences. Such variant Fc domains include amino acid modifications to facilitate the self-assembly and/or purification of the heterodimeric antibodies.

An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in biasing the formation of the desired heterodimeric antibody over the formation of the homodimers and/or purifying the heterodimeric antibody away from the homodimers.

There are a number of mechanisms that can be used to generate the subject heterodimeric antibodies. In addition, as will be appreciated by those in the art, these different mechanisms can be combined to ensure high heterodimerization. Amino acid modifications that facilitate the production and purification of heterodimers are collectively referred to generally as "heterodimerization variants." As discussed below, heterodimerization variants include "skew" variants (e.g., the "knobs and holes" and the "charge pairs" variants described below) as well as "pI variants," which allow purification of heterodimers from homodimers. As is generally described in U.S. Pat. No. 9,605,084, hereby incorporated by reference in its entirety and specifically as below for the discussion of heterodimerization variants, useful mechanisms for heterodimerization include "knobs and holes" ("KIH") as described in U.S. Pat. No. 9,605,084, "electrostatic steering" or "charge pairs" as described in U.S. Pat. No. 9,605,084, pI variants as described in U.S. Pat. No. 9,605,084, and general additional Fc variants as outlined in U.S. Pat. No. 9,605,084 and below.

Heterodimerization variants that are useful for the formation and purification of the subject heterodimeric antibody (e.g., bispecific antibodies) are further discussed in detailed below.

1. Skew Variants

In some embodiments, the heterodimeric antibody includes skew variants which are one or more amino acid modifications in a first Fc domain (A) and/or a second Fc domain (B) that favor the formation of Fc heterodimers (Fc dimers that include the first and the second Fc domain; (A-B) over Fc homodimers (Fc dimers that include two of the first Fc domain or two of the second Fc domain; A-A or B-B). Suitable skew variants are included in the FIG. 29 of US Publ. App. No. 2016/0355608, hereby incorporated by reference in its entirety and specifically for its disclosure of skew variants, as well as in FIGS. 3 and 9.

One particular type of skew variants is generally referred to in the art as "knobs and holes," referring to amino acid engineering that creates steric influences to favor heterodimeric formation and disfavor homodimeric formation, as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety and specifically for the disclosure of "knobs and holes" mutations. This is sometime referred to herein as "steric variants." The figures identify a number of "monomer A-monomer B" pairs that rely on "knobs and holes". In addition, as described in Merchant et al., Nature Biotech. 16:677 (1998), these "knobs and holes" mutations can be combined with disulfide bonds to further favor formation of Fc heterodimers.

Another method that finds use in the generation of heterodimers is sometimes referred to as "electrostatic steering" as described in Gunasekaran et al., J. Biol. Chem. 285(25): 19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "skew variants". These include, but are not limited to, D221E/P228E/L368E paired with D221R/P228R/K409R (e.g., these are "monomer corresponding sets) and C220E/P228E/368E paired with C220R/E224R/P228R/K409R.

In some embodiments, the skew variants advantageously and simultaneously favor heterodimerization based on both the "knobs and holes" mechanism as well as the "electrostatic steering" mechanism. In some embodiments, the heterodimeric antibody includes one or more sets of such heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other. That is, these pairs of sets may instead form an interface between the two monomers that encourages heterodimer formation and discourages homodimer formation, allowing the percentage of heterodimers that spontaneously form under biological conditions to be over 90%, rather than the expected 50% (25% homodimer A/A:50% heterodimer A/B:25% homodimer B/B). Exemplary heterodimerization "skew" variants are depicted in FIG. 4. In exemplary embodiments, the heterodimeric antibody includes a S364K/E357Q: L368D/K370S; L368D/K370S: S364K; L368E/K370S: S364K; T411T/E360E/Q362E: D401K; L368D/K370S: S364K/E357L; K370S: S364K/E357Q; or a T366S/L368A/Y407V: T366W (optionally including a bridging disulfide, T366S/L368A/Y407V/Y349C: T366W/S354C) "skew" variant amino acid substitution set. In an exemplary embodiment, the heterodimeric antibody includes a "S364K/E357Q: L368D/K370S" amino acid substitution set. In terms of nomenclature, the pair "S364K/E357Q: L368D/K370S" means that one of the monomers includes an Fc domain that includes the amino acid substitutions S364K and E357Q and the other monomer includes an Fc domain that includes the amino acid substitutions L368D and K370S; as above, the "strandedness" of these pairs depends on the starting pI.

In some embodiments, the skew variants provided herein can be optionally and independently incorporated with any other modifications, including, but not limited to, other skew variants (see, e.g., in FIG. 37 of US Publ. App. No. 2012/0149876, herein incorporated by reference, particularly for its disclosure of skew variants), pI variants, isotpypic variants, FcRn variants, ablation variants, etc. into one or both of the first and second Fc domains of the heterodimeric antibody. Further, individual modifications can also independently and optionally be included or excluded from the subject the heterodimeric antibody.

In some embodiments, the skew variants outlined herein can be optionally and independently incorporated with any pI variant (or other variants such as Fc variants, FcRn variants, etc.) into one or both heavy chain monomers, and can be independently and optionally included or excluded from the subject heterodimeric antibodies.

2. pI (Isoelectric point) Variants for Heterodimers

In some embodiments, the heterodimeric antibody includes purification variants that advantageously allow for the separation of heterodimeric antibody (e.g., anti-B7H3 x anti-CD28 bispecific antibody) from homodimeric proteins.

There are several basic mechanisms that can lead to ease of purifying heterodimeric antibodies. For example, modifications to one or both of the antibody heavy chain monomers A and B such that each monomer has a different pI allows for the isoelectric purification of heterodimeric A-B antibody from monomeric A-A and B-B proteins. Alternatively, some scaffold formats, such as the "1+1 Fab-scFv-Fc" format, the "2+1 $Fab_2$-scFv-Fc" format, and the "2+1 CLC" format allows separation on the basis of size. As described above, it is also possible to "skew" the formation of heterodimers over homodimers using skew variants. Thus, a combination of heterodimerization skew variants and pI variants find particular use in the heterodimeric antibodies provided herein.

Additionally, as more fully outlined below, depending on the format of the heterodimeric antibody, pI variants either contained within the constant region and/or Fc domains of a monomer, and/or domain linkers can be used. In some embodiments, the heterodimeric antibody includes additional modifications for alternative functionalities that can also create pI changes, such as Fc, FcRn and KO variants.

In some embodiments, the subject heterodimeric antibodies provided herein include at least one monomer with one or more modifications that alter the pI of the monomer (i.e., a "pI variant"). In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Depending on the format of the heterodimer antibody, pI variants can be either contained within the constant and/or Fc domains of a monomer, or charged linkers, either domain linkers or scFv linkers, can be used. That is, antibody formats that utilize scFv(s) such as "1+1 Fab-scFv-Fc", format can include charged scFv linkers (either positive or negative), that give a further pI boost for purification purposes. As will be appreciated by those in the art, some 1+1 Fab-scFv-Fc and 2+1 $Fab_2$-scFv-Fc formats are useful with just charged scFv linkers and no additional pI adjustments, although the invention does provide pI variants that are on one or both of the monomers, and/or charged domain linkers as well. In addition, additional amino acid engineering for alternative functionalities may also confer pI changes, such as Fc, FcRn and KO variants.

In subject heterodimeric antibodies that utilizes pI as a separation mechanism to allow the purification of heterodimeric proteins, amino acid variants are introduced into one or both of the monomer polypeptides. That is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g., a neutral amino acid is replaced by a positively or negatively charged amino acid residue, e.g., glycine to glutamic acid), changing a charged residue from positive or negative to the opposite charge (aspartic acid to lysine) or changing a charged residue to a neutral residue (e.g., loss of a charge; lysine to serine). A number of these variants are shown in the FIGS. 3 and 4.

Thus, in some embodiments, the subject heterodimeric antibody includes amino acid modifications in the constant regions that alter the isoelectric point (pI) of at least one, if not both, of the monomers of a dimeric protein to form "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components, for example in the 1+1 Fab-scFv-Fc, 2+1

$Fab_2$-scFv-Fc, 1+1 CLC and 2+1 CLC formats, the starting pI of the scFv (1+1 Fab-scFv-Fc, 2+1 $Fab_2$-scFv-Fc) and Fab(s) of interest. That is, to determine which monomer to engineer or in which "direction" (e.g., more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

In the case where pI variants are used to achieve heterodimerization, by using the constant region(s) of the heavy chain(s), a more modular approach to designing and purifying bispecific proteins, including antibodies, is provided. Thus, in some embodiments, heterodimerization variants (including skew and pI heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g., the minimization or avoidance of non-human residues at any particular position. Alternatively or in addition to isotypic substitutions, the possibility of immunogenicity resulting from the pI variants is significantly reduced by utilizing isosteric substitutions (e.g. Asn to Asp; and Gln to Glu).

As discussed below, a side benefit that can occur with this pI engineering is also the extension of serum half-life and increased FcRn binding. That is, as described in US Publ. App. No. US 2012/0028304 (incorporated by reference in its entirety), lowering the pI of antibody constant domains (including those found in antibodies and Fc fusions) can lead to longer serum retention in vivo. These pI variants for increased serum half-life also facilitate pI changes for purification.

In addition, it should be noted that the pI variants give an additional benefit for the analytics and quality control process of bispecific antibodies, as the ability to either eliminate, minimize and distinguish when homodimers are present is significant. Similarly, the ability to reliably test the reproducibility of the heterodimeric antibody production is important.

In general, embodiments of particular use rely on sets of variants that include skew variants, which encourage heterodimerization formation over homodimerization formation, coupled with pI variants, which increase the pI difference between the two monomers to facilitate purification of heterodimers away from homodimers.

Exemplary combinations of pI variants are shown in FIGS. 4 and 5, and FIG. 30 of US Publ. App. No. 2016/0355608, all of which are herein incorporated by reference in its entirety and specifically for the disclosure of pI variants. Preferred combinations of pI variants are shown in FIGS. 3 and 4. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including $(GKPGS)_4$ (SEQ ID NO:796). However, as will be appreciated by those in the art, the first monomer includes a CH1 domain, including position 208. Accordingly, in constructs that do not include a CH1 domain (for example for antibodies that do not utilize a CH1 domain on one of the domains), a preferred negative pI variant Fc set includes 295E/384D/418E/421D variants (Q295E/N384D/Q418E/N421D when relative to human IgG1).

Accordingly, in some embodiments, one monomer has a set of substitutions from FIG. 4 and the other monomer has a charged linker (either in the form of a charged scFv linker because that monomer comprises an scFv or a charged domain linker, as the format dictates, which can be selected from those depicted in FIG. 6).

In some embodiments, modifications are made in the hinge of the Fc domain, including positions 216, 217, 218, 219, 220, 221, 222, 223, 224, 225, 226, 227, 228, 229, and 230 based on EU numbering. Thus, pI mutations and particularly substitutions can be made in one or more of positions 216-230, with 1, 2, 3, 4 or 5 mutations finding use. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 233, 234, 235, 236, 274, 296, 300, 309, 320, 322, 326, 327, 334 and 339, based on EU numbering. It should be noted that changes in 233-236 can be made to increase effector function (along with 327A) in the IgG2 backbone. Again, all possible combinations of these 14 positions can be made; e.g., an anti-CD28 or anti-B7H3 antibody provided herein may include a variant Fc domain with 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non-native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non-native threonine at position 339, and all possible combinations within CH2 and with other domains.

In this embodiment, the modifications can be independently and optionally selected from position 355, 359, 362, 384, 389,392, 397, 418, 419, 444 and 447 (EU numbering) of the CH3 region. Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non-native glutamic acid at position 419, a non-native glutamic acid at position 359, a non-native glutamic acid at position 362, a non-native glutamic acid at position 389, a non-native glutamic acid at position 418, a non-native glutamic acid at position 444, and a deletion or non-native aspartic acid at position 447.

3. Isotypic Variants

In addition, many embodiments of the subject heterodimeric antibodies rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

4. Calculating pI

The pI of each monomer of the antibodies provided herein can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

5. pI Variants that Also Confer Better FcRn In Vivo Binding

In the case where the pI variant decreases the pI of the monomer, the pI variant can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall' Acqua et al. showed that Fc mutants with increased FcRn binding at pH 6 and pH 7.4 actually had reduced serum concentrations and the same half-life as wild-type Fc (Dall' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

D. Additional Fc Variants for Additional Functionality

In addition to the heterodimerization variants discussed above, there are a number of useful Fc amino acid modification that can be made for a variety of reasons, including, but not limited to, altering binding to one or more FcγR receptors, altered binding to FcRn receptors, etc, as discussed below.

Accordingly, the antibodies provided herein (heterodimeric, as well as homodimeric) can include such amino acid modifications with or without the heterodimerization variants outlined herein (e.g., the pI variants and steric variants). Each set of variants can be independently and optionally included or excluded from any particular heterodimeric protein.

1. FcγR Variants

Accordingly, there are a number of useful Fc substitutions that can be made to alter binding to one or more of the FcγR receptors. In certain embodiments, the subject antibody includes modifications that alter the binding to one or more FcγR receptors (i.e., "FcγR variants"). Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the subject antibodies include those listed in U.S. Pat. No. 8,188,321 (particularly FIG. 41) and U.S. Pat. No. 8,084,582, and US Publ. App. Nos. 20060235208 and 20070148170, all of which are expressly incorporated herein by reference in their entirety and specifically for the variants disclosed therein that affect Fcγ receptor binding. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T. Such modification may be included in one or both Fc domains of the subject antibody.

In some embodiments, the subject antibody includes one or more Fc modifications that increase serum half-life. Fc substitutions that find use in increased binding to the FcRn receptor and increased serum half-life, as specifically disclosed in U.S. Ser. No. 12/341,769, hereby incorporated by reference in its entirety, including, but not limited to, 4345, 434A, 428L, 308F, 259I, 428L/434S, 259I/308F, 436I/428L, 436I or V/434S, 436V/428L and 259I/308F/428L. Such modification may be included in one or both Fc domains of the subject antibody.

2. Ablation Variants

In some embodiments, the heterodimeric antibody (e.g., anti-B7H3 x anti-CD28 bispecific antibody) includes one or more modifications that reduce or remove the normal binding of the Fc domain to one or more or all of the Fcγ receptors (e.g., FcγR1, FcγRIIa, FcγRIIb, FcγRIIIa, etc.) to avoid additional mechanisms of action. Such modifications are referred to as "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of bispecific antibodies that bind CD28 monovalently, it is generally desirable to ablate FcγRIIIa binding to eliminate or significantly reduce ADCC activity. In some embodiments, of the subject antibodies described herein, at least one of the Fc domains comprises one or more Fcγ receptor ablation variants. In some embodiments, of the subject antibodies described herein, both of the Fc domains comprises one or more Fcγ receptor ablation variants. These ablation variants are depicted in FIG. 5, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

As is known in the art, the Fc domain of human IgG1 has the highest binding to the Fcγ receptors, and thus ablation variants can be used when the constant domain (or Fc domain) in the backbone of the heterodimeric antibody is IgG1. Alternatively, or in addition to ablation variants in an IgG1 background, mutations at the glycosylation position 297 (generally to A or S) can significantly ablate binding to FcγRIIIa, for example. Human IgG2 and IgG4 have naturally reduced binding to the Fcγ receptors, and thus those backbones can be used with or without the ablation variants.

E. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

Exemplary combination of variants that are included in some embodiments of the heterodimeric 1+1 Fab-scFv-Fc, 2+1 $Fab_2$-scFv-Fc, 1+1 CLC and 2+1 CLC format antibodies are included in FIG. 8. In some embodiments, the heterodimeric antibody includes a combination of variants as depicted in FIG. 8. In certain embodiments, the antibody is a heterodimeric 11+1 Fab-scFv-Fc, 2+1 $Fab_2$-scFv-Fc, 1+1 CLC or 2+1 CLC format antibody.

F. Useful Antibody Formats

As will be appreciated by those in the art and discussed more fully below, the heterodimeric bispecific antibodies provided herein can take on several different configurations as generally depicted in FIGS. 33 and 34.

As will be appreciated by those in the art, the heterodimeric formats of the invention can have different valencies as well as be bispecific. That is, heterodimeric antibodies of the invention can be bivalent and bispecific, or trivalent and bispecific, wherein the first antigen is bound by two binding domains and the second antigen by a second binding domain. As is outlined herein, when CD28 is one of the target antigens, it is preferable that the CD28 is bound only monovalently.

The present invention utilizes CD28 antigen binding domains in combination with B7H3 binding domains. As will be appreciated by those in the art, any collection of anti-CD28 CDRs, anti-CD28 variable light and variable heavy domains, Fabs and scFvs as depicted in any of the figures (see particularly FIGS. 16-21) can be used. Similarly, any of the anti-B7H3 antigen binding domains can be used, whether CDRs, variable light and variable heavy domains, Fabs and scFvs as depicted in any of the Figures (e.g., FIGS. 29-31) can be used, optionally and independently combined in any combination.

1. 1+1 Fab-scFv-Fc format ("Bottle Opener")

One heterodimeric antibody format that finds particular use in subject bispecific antibodies provided herein (e.g., anti-CD28 x anti-B7H3 antibody) is the "1+1 Fab-scFv-Fc" or "bottle opener" format as shown in FIG. 33A. The 1+1 Fab-scFv-Fc format antibody includes a first monomer that is a "regular" heavy chain (VH1-CH1-hinge-CH2—CH3), wherein VH1 is a first variable heavy domain and CH2-CH3 is a first Fc domain. The 1+1 Fab-scFv-Fc also includes a light chain that includes a first variable light domain VL1 and a constant light domain CL. The light chain interacts with the VH1-CH1 of the first monomer to form a first antigen binding domain that is a Fab. The second monomer of the antibody includes a second binding domain that is a single chain Fv ("scFv", as defined below) and a second Fc domain. The scFv includes a second variable heavy domain (VH2) and a second variable light domain (VL2), wherein the VH2 is attached to the VL2 using an scFv linker that can be charged (see, e.g., FIG. 6). The scFv is attached to the heavy chain using a domain linker (see, e.g., FIG. 7). The two monomers are brought together by the use of amino acid variants (e.g., heterodimerization variants, discussed above) in the constant regions (e.g., the Fc domain, the CH1 domain and/or the hinge region) that promote the formation of heterodimeric antibodies as is described more fully below. This structure is sometimes referred to herein as the "bottle-opener" format, due to a rough visual similarity to a bottle-opener. In some embodiments, the 1+1 Fab-scFv-Fc format antibody is a bivalent antibody.

There are several distinct advantages to the present "1+1 Fab-scFv-Fc" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g., heavy 1 pairing with light 2, etc.).

In some embodiments of the 1+1 Fab-scFv-Fc format antibody, one of the first or second antigen binding domain is a CD28 binding domain and the other binding domain is a tumor associated antigen (TAA) binding domain. In some embodiments where the 1+1 Fab-scFv-Fc includes a CD28 binding domain and a tumor associated antigen (TAA) binding domain, it is the scFv that binds to the CD28, and the Fab that binds the TAA. In some embodiments, the TAA is B7H3. Exemplary anti-B7H3 x anti-CD28 bispecific antibodies in the 1+1 Fab-scFv-Fc format is depicted in FIG. 35.

In some embodiments, the first and second Fc domains of the 1+1 Fab-scFv-Fc format antibody are variant Fc domains that include heterodimerization skew variants (e.g., a set of amino acid substitutions as shown in FIGS. 3 and 9). Particularly useful heterodimerization skew variants include S364K/E357Q: L368D/K370S; L368D/K370S: S364K; L368E/K370S: S364K; T411T/E360E/Q362E: D401K; L368D/K370S: S364K/E357L; K370S: S364K/E357Q; T366S/L368A/Y407V: T366W and T366S/L368A/Y407V/Y349C: T366W/S354C (EU numbering)). In exemplary embodiments, one of the first or second variant Fc domains includes heterodimerization skew variants L368D/K370S and the other of the first or second variant Fc domains includes heterodimerization skew variants S364K/E357Q, wherein numbering is according to EU numbering. In exemplary embodiments, the first variant Fc domain includes heterodimerization skew variants L368D/K370S and the second variant Fc domain includes heterodimerization skew variants S364K/E357Q, wherein numbering is according to EU numbering.

In some embodiments, the variant Fc domains include ablation variants (including those shown in FIG. 5). In some embodiments, each of the first and second variant Fc domains include ablation variants E233P/L234V/L235A/G236_/S267K, wherein numbering is according to EU numbering.

In some embodiments, the constant domain (CH1-hinge-CH2-CH3) of the first monomer includes pI variants (including those shown in FIG. 4). In exemplary embodiments, the constant domain (CH1-hinge-CH2-CH3) of the first monomer includes pI variants N208D/Q295E/N384D/Q418E/N421D, wherein numbering is according to EU numbering.

In exemplary embodiments, the CH1-hinge-CH2-CH3 of the first monomer comprises amino acid variants L368D/K370S/N208D/Q295E/N384D/Q418E/N421D/E233P/L234V/L235A/G236del/S267 K, the second Fc domain comprises amino acid variants S364K/E357Q/E233P/L234V/L235A/G236del/S267K, wherein numbering is according to EU numbering.

In some embodiments, the scFv of the 1+1 Fab-scFv-Fc format antibody provided herein includes a charged scFv linker (including those shown in FIG. 6). In some embodiments, the 1+1 Fab-scFv-Fc format antibody provided herein includes FcRn variants M428L/N434S, wherein numbering is according to EU numbering.

In exemplary embodiments, the first variant Fc domain includes heterodimerization skew variants L368D/K370S and the second variant Fc domain includes heterodimerization skew variants S364K/E357Q; each of the first and second variant Fc domains include ablation variants E233P/L234V/L235A/G236_/S267K; and the constant domain (CH1-hinge-CH2-CH3) of the first monomer includes pI variants N208D/Q295E/N384D/Q418E/N421D, wherein numbering is according to EU numbering. In some embodiments, the scFv of the 1+1 Fab-scFv-Fc format antibody provided herein includes a $(GKPGS)_4$ charged scFv linker. In some embodiments, the 1+1 Fab-scFv-Fc format antibody provided herein includes FcRn variants M428L/N434S, wherein numbering is according to EU numbering.

In some embodiments, one of the first binding domain or the second binding domain binds CD28 and the other binding domain binds a tumor associated antigen (TAA) (see FIG. 34A). Any suitable CD28 binding domain can be included in subject 1+1 Fab-scFv-Fc format antibody, including any of the CD28 binding domains provided herein. In some embodiments, the CD28 binding domain is one of the following CD28 binding domains or a variant thereof: 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, TGN1412_H1L1, 341VL34[CD28]_ H1L1, 341VL36[CD28]_H1L1, 281VL4[CD28]_ H1L1, HuTN228[CD28]_H1L1, PV1[CD28]_H0L0, m9.3[CD28]_ H0L0, hu9.3[CD28]_H1L1 (FIGS. 18-21 and 23 and Sequence Listing).

In some embodiments of the mAb-scFv format, the anti-CD28 ABD has a VH domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO: 1198, SEQ ID NO: 1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, one of the first binding domain or the second binding domain of the 1+1 Fab-scFv-Fc format antibody binds a tumor associated antigen (TAA). Suitable TAAs include any of the TAAs disclosed herein. In exemplary embodiments, the TAA is B7H3. Any suitable B7H3 binding domain can be included in subject 1+1 Fab-scFv-Fc format antibody, including any of the B7H3 binding domains provided herein. In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing).

In some embodiments, the anti-B7H3 ABD has a VL domain with an amino acid sequence selected from the group consisting of a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and a VL domain having the amino acid sequence selected from the group consisting of SEQ ID NO:874 and SEQ ID NO: 932.

In some embodiments, the anti-B7H3 ABD comprises a VH domain having the amino acid sequence of SEQ ID NO:946; and a variable light domain having the amino acid sequence of SEQ ID NO:950.

In some embodiments, the the anti-B7H3 ABD comprises a VH domain having the amino acid sequence of SEQ ID NO:956; and a variable light domain having the amino acid sequence of SEQ ID NO:960.

In some embodiments, the anti-B7H3 ABD comprises a VH domain having the amino acid sequence of SEQ ID NO:964; and a variable light domain having the amino acid sequence of SEQ ID NO:968.

In some embodiments, the anti-B7H3 ABD comprises a VH domain having the amino acid sequence of SEQ ID NO:972; and a variable light domain having the amino acid sequence of SEQ ID NO:976.

In some embodiments, the 1+1 Fab-scFv-Fc format antibody includes a first binding domain that binds CD28 and a second binding domain that binds B7H3. In some embodiments, the CD28 binding domain is one of the following CD28 binding domains or a variant thereof: 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1 (FIGS. 18-21 and 23 and Sequence Listing).

In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, and m1704 (FIGS. 26-31 and the Sequence Listing).

In some embodiments, the anti-B7H3 ABD has a VH domain and VL domain with amino acid sequences selected from the pairs of a) SEQ ID NOs: 89 and 93 from omburamab, b) SEQ ID NOs:97 and 101 from enoblituzumab, c) SEQ ID NOs:105 and 109 from BRCA84D, d) SEQ ID NOs:113 and 117 from BRCA69D, e) SEQ ID NOs:121 and 125 from PRCA157, f) SEQ ID NOs:129 and 133 from huPRCA157, g) SEQ ID NOs:137 and 141 from Mab-D; h) SEQ ID NOs:145 and 149 humAb-D; i) SEQ ID NOs:153 and 157 from m30; j) SEQ ID NOs:161 and 165 from M30-H1-L4, k) SEQ ID NOs:169 and 173 SP265; 1) SEQ ID NOs:177 and 181 from S10-H50L58; m) SEQ ID NOs:185 and 189 from 8H9, n) SEQ ID NOs:193 and 197 from m852; o) SEQ ID NOs:201 and 205 from m857; p) SEQ ID NOs:209 and 213 from m8524; q) SEQ ID NOs:217 and 221 from 1-1; r) SEQ ID NOs:225 and 229 from 1-2; s) SEQ ID NOs:233 and 237 from 1-4; t) SEQ ID NOs:241 and 245 from 1-5; u) SEQ ID NOs:249 and 253 from 1-7; v) SEQ ID NOs:257 and 261 from 2-5; w) SEQ ID NOs:265 and 269 from 2-8; x) SEQ ID NOs: 273 and 277 from chAb2; y) SEQ ID NOs:281 and 285 chAb3; z) SEQ ID NOs:289 and 293 from chAb4; aa) SEQ ID NOs:297 and 301 from chAb18; bb) SEQ ID NOs:305 and 309 from chAb13; cc) SEQ ID NOs:313 and 317 from chAb12; dd) SEQ ID NOs:321 and 325 from chAb14; ee) SEQ ID NOs:329 and 333 from chAb6; ff) SEQ ID NOs:337 and 341 from chAb11, gg) SEQ ID NOs:345 and 349 from chAB16; hh) SEQ ID NOs:353 and 357 from chAb10; ii) SEQ ID NOs:361 and 365 from ChAb7; jj) SEQ ID NOs: 369 and 373 from chAb8, kk) SEQ ID NOs:377 and 381 from chAb17; ll) SEQ ID NOs:385 and 389 from chAb5, mm) SEQ ID NOs:393 and 397 from huAb3v2.5, nn) SEQ ID NOs:401 and 405 from huAb3v2.6, pp) SEQ ID NOs:409 and 413 from huAb13v1, qq) SEQ ID NOs:417 and 421 from TPP-5706, rr) SEQ ID NOs:425 and 429 from TPP-6642; ss) SEQ ID NOs:433 and 437 from TPP-6850, tt) SEQ ID NOs:441 and 445 from TPP-3803, uu) SEQ ID NOs:449 and 453 from TRL4542, vv) SEQ ID NOs:457 and 461 from h1702, ww) SEQ ID NOs:465 and 469 from h1703, xx) SEQ ID NOs:473 and 477 from huA3, yy) SEQ ID NOs:481 and 485 from huA9 and zz) SEQ ID NOs: 489 and 493 from m1704. See FIG. 17 from U.S. Ser. No. 63/092,272.

FIG. 10 shows some exemplary Fc domain sequences that are useful in the 1+1 Fab-scFv-Fc format antibodies. The "monomer 1" sequences depicted in FIG. 10 typically refer to the Fc domain of the "Fab-Fc heavy chain" and the "monomer 2" sequences refer to the Fc domain of the "scFv-Fc heavy chain." In addition, FIGS. 12-15 provides exemplary CH1-hinge domains, CH1 domains, and hinge domains that can be included in the first or second monomer of the 1+1 Fab-scFv-Fc format. Further, FIG. 16 provides useful CL sequences that can be used with this format.

2. 2+1 $Fab_2$-scFv-Fc Format (Central-scFv Format)

One heterodimeric antibody format that finds particular use in the subject bispecific antibodies provided herein (e.g., anti-CD28 x anti-B7H3 antibody) is the 2+1 $Fab_2$-scFv-Fc format (also referred to as "central-scFv format") shown in FIG. 33B. This antibody format includes three antigen binding domains: two Fab portions and an scFv that is inserted between the VH-CH1 and CH2-CH3 regions of one of the monomers. In some embodiments of this format, the Fab portions each bind a tumor associated antigen (TAA) and the "extra" scFv domain binds CD28. In some embodiments, the 2+1 $Fab_2$-scFv-Fc format antibody is a trivalent antibody.

In some embodiments of the 2+1 $Fab_2$-scFv-Fc format, a first monomer includes a standard heavy chain (i.e., VH1-CH1-hinge-CH2-CH3), wherein VH1 is a first variable heavy domain and CH2-CH3 is a first Fc domain. A second monomer includes another first variable heavy domain (VH1), a CH1 domain (and optional hinge), a second Fc domain, and an scFv that includes an scFv variable light domain (VL2), an scFv linker and a scFv variable heavy domain (VH2). The scFv is covalently attached between the C-terminus of the CH1 domain of the second monomer and the N-terminus of the second Fc domain using optional domain linkers (VH1-CH1-[optional linker]-VH2-scFv linker-VH2-[optional linker]-CH2-CH3, or the opposite orientation for the scFv, VH1-CH1-[optional linker]-VL2-scFv linker-VH2-[optional linker]-CH2-CH3). The optional linkers can be any suitable peptide linkers, including, for example, the domain linkers included in FIG. 7. This embodiment further utilizes a common light chain that includes a variable light domain (VL1) and a constant light domain (CL). The common light chain associates with the VH1-CH1 of the first and second monomers to form two identical Fabs. In some embodiments, the identical Fabs each bind a tumor associated antigen (e.g., B7H3). As for many of the embodiments herein, these constructs can include skew variants, pI variants, ablation variants, additional Fc variants, etc. as desired and described herein.

In some embodiments, the first and second Fc domains of the 2+1 $Fab_2$-scFv-Fc format antibody are variant Fc domains that include heterodimerization skew variants (e.g., a set of amino acid substitutions as shown in FIGS. 3 and 9). Particularly useful heterodimerization skew variants include S364K/E357Q: L368D/K370S; L368D/K370S: S364K; L368E/K370S: S364K; T411T/E360E/Q362E: D401K; L368D/K370S: S364K/E357L; K370S: S364K/E357Q; T366S/L368A/Y407V: T366W and T366S/L368A/Y407V/Y349C: T366W/S354C (EU numbering)). In exemplary embodiments, one of the first or second variant Fc domains includes heterodimerization skew variants L368D/K370S and the other of the first or second variant Fc domains includes heterodimerization skew variants S364K/E357Q, wherein numbering is according to EU numbering. In exemplary embodiments, the first variant Fc domain includes heterodimerization skew variants L368D/K370S and the second variant Fc domain includes heterodimerization skew variants S364K/E357Q, wherein numbering is according to EU numbering.

In some embodiments, the variant Fc domains include ablation variants (including those shown in FIG. 5). In some embodiments, each of the first and second variant Fc domains include ablation variants E233P/L234V/L235A/G236_/S267K, wherein numbering is according to EU numbering.

In some embodiments, the constant domain (CH1-hinge-CH2-CH3) of the first monomer includes pI variants (including those shown in FIG. 4). In exemplary embodiments, the constant domain (CH1-hinge-CH2-CH3) of the first monomer includes pI variants N208D/Q295E/N384D/Q418E/N421D, wherein numbering is according to EU numbering.

In some embodiments, the scFv of the 2+1 $Fab_2$-scFv-Fc format antibody provided herein includes a charged scFv linker (including those shown in FIG. 6). In some embodiments, the 2+1 $Fab_2$-scFv-Fc format antibody provided herein includes FcRn variants M428L/N434S, wherein numbering is according to EU numbering.

In exemplary embodiments, the first variant Fc domain includes heterodimerization skew variants L368D/K370S and the second variant Fc domain includes heterodimerization skew variants S364K/E357Q; each of the first and second variant Fc domains include ablation variants E233P/L234V/L235A/G236_/S267K; and the constant domain (CH1-hinge-CH2-CH3) of the first monomer includes pI variants N208D/Q295E/N384D/Q418E/N421D, wherein numbering is according to EU numbering.

In some embodiments, the scFv of the 2+1 $Fab_2$-scFv-Fc format antibody provided herein includes a $(GKPGS)_4$ charged scFv linker. In some embodiments, the 2+1 $Fab_2$-scFv-Fc format antibody provided herein includes FcRn variants M428L/N434S, wherein numbering is according to EU numbering.

In some embodiments, the CH1-hinge-CH2-CH3 of the first monomer comprises amino acid variants L368D/K370S/N208D/Q295E/N384D/Q418E/N421D/E233P/L234V/L235A/G236del/S267 K, and the second Fc domain comprises amino acid variants S364K/E357Q/E233P/L234V/L235A/G236del/S267K, wherein numbering is according to EU numbering.

In some embodiments, the scFv of the second monomer of the 2+1 $Fab_2$-scFv-Fc format antibody is a CD28 binding and the VH1 of the first and second monomer and the VL1 of the common light chain each form binding domains that bind a tumor associated antigen (TAA, e.g., B7H3) (see FIG. 34B). Any suitable CD28 binding domain can be included in subject 2+1 $Fab_2$-scFv-Fc format antibody, including any of the CD28 binding domains provided herein. In some embodiments, the CD28 binding domain is one of the following CD28 binding domains or a variant thereof:

1A7[CD28]_H1.14L1, 1A7[CD28]_H1_L1.71, 1A7 [CD28]_ H1.1_L1.71, 1A7[CD28]_H1.14_L1.71, CD28.3 [CD28]_ H0L0, TGN1412_H1L1, 341VL34[CD28]_H1L1, 341VL36[CD28]_H1L1, 281VL4[CD28]_H1L1, HuTN228 [CD28]_H1L1, PV1[CD28]_H0L0, m9.3[CD28]_H0L0, hu9.3[CD28]_H1L1 (FIGS. 18-21 and 23 and the Sequence Listing). In some embodiments of the mAb-scFv format, the anti-CD28 ABD has a VH domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO: 1198, SEQ ID NO: 1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, the VH1 of the first and second monomer and the VL1 of the common light chain of the 2+1 $Fab_2$-scFv-Fc format antibody each form a binding domain that binds a tumor associated antigen (TAA) (see FIG. 34B). Suitable TAAs include any of the TAAs disclosed herein. In exemplary embodiments, the TAA is B7H3. Any suitable B7H3 binding domain can be included in subject 2+1 $Fab_2$-scFv-Fc format antibody, including any of the B7H3 binding domains provided herein. In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189 [B7H3]_H1.22L1, 2E4A3.189[B7H3]_H1.22/1A7[CD28]_ L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing). In some embodiments, the anti-B7H3 ABD has a VH domain and VL domain with amino acid sequences selected from the pairs of a) SEQ ID NOs: 89 and 93 from omburamab, b) SEQ ID NOs:97 and 101 from enoblituzumab, c) SEQ ID NOs:105 and 109 from BRCA84D, d) SEQ ID NOs:113 and 117 from BRCA69D, e) SEQ ID NOs:121 and 125 from PRCA157, f) SEQ ID NOs:129 and 133 from huPRCA157, g) SEQ ID NOs:137 and 141 from Mab-D; h) SEQ ID NOs:145 and 149 humAb-D; i) SEQ ID NOs:153 and 157 from m30; j) SEQ ID NOs:161 and 165 from M30-H1-L4, k) SEQ ID NOs:169 and 173 SP265; 1) SEQ ID NOs:177 and 181 from S10-H50L58; m) SEQ ID NOs:185 and 189 from 8H9, n) SEQ ID NOs:193 and 197 from m852; o) SEQ ID NOs:201 and 205 from m857; p) SEQ ID NOs:209 and 213 from m8524; q) SEQ ID NOs:217 and 221 from 1-1; r) SEQ ID NOs:225 and 229 from 1-2; s) SEQ ID NOs:233 and 237 from 1-4; t) SEQ ID NOs:241 and 245 from 1-5; u) SEQ ID NOs:249 and 253 from 1-7; v) SEQ ID NOs:257 and 261 from 2-5; w) SEQ ID NOs:265 and 269 from 2-8; x) SEQ ID NOs: 273 and 277 from chAb2; y) SEQ ID NOs:281 and 285 chAb3; z) SEQ ID NOs:289 and 293 from chAb4; aa) SEQ ID NOs:297 and 301 from chAb18; bb) SEQ ID NOs:305 and 309 from chAb13; cc) SEQ ID NOs:313 and 317 from chAb12; dd) SEQ ID NOs:321 and 325 from chAb14; ee) SEQ ID NOs:329 and 333 from chAb6; ff) SEQ ID NOs:337 and 341 from chAb11, gg) SEQ ID NOs:345 and 349 from chAB16; hh) SEQ ID NOs:353 and 357 from chAb10; ii) SEQ ID NOs:361 and 365 from ChAb7; jj) SEQ ID NOs: 369 and 373 from chAb8, kk) SEQ ID NOs:377 and 381 from chAb17; 11) SEQ ID NOs:385 and 389 from chAb5, mm) SEQ ID NOs:393 and 397 from huAb3v2.5, nn) SEQ ID NOs:401 and 405 from huAb3v2.6, pp) SEQ ID NOs:409 and 413 from huAb13v1, qq) SEQ ID NOs:417 and 421 from TPP-5706, rr) SEQ ID NOs:425 and 429 from TPP-6642; ss) SEQ ID NOs:433 and 437 from TPP-6850, tt) SEQ ID NOs:441 and 445 from TPP-3803, uu) SEQ ID NOs:449 and 453 from TRL4542, vv) SEQ ID NOs:457 and 461 from h1702, ww) SEQ ID NOs:465 and 469 from h1703, xx) SEQ ID NOs:473 and 477 from huA3, yy) SEQ ID NOs:481 and 485 from huA9 and zz) SEQ ID NOs: 489 and 493 from m1704. See FIG. 17 from U.S. Ser. No. 63/092,272.

In some embodiments, the anti-B7H3 ABD has a VL domain with an amino acid sequence selected from the group consisting of a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and a VL domain having the amino acid sequence selected from the group consisting of SEQ ID NO:874 and SEQ ID NO: 932.

In some embodiments, the anti-B7H3 ABD comprises a VH domain having the amino acid sequence of SEQ ID NO:946; and a variable light domain having the amino acid sequence of SEQ ID NO:950.

In some embodiments, the the anti-B7H3 ABD comprises a VH domain having the amino acid sequence of SEQ ID NO:956; and a variable light domain having the amino acid sequence of SEQ ID NO:960.

In some embodiments, the anti-B7H3 ABD comprises a VH domain having the amino acid sequence of SEQ ID NO:964; and a variable light domain having the amino acid sequence of SEQ ID NO:968.

In some embodiments, the anti-B7H3 ABD comprises a VH domain having the amino acid sequence of SEQ ID NO:972; and a variable light domain having the amino acid sequence of SEQ ID NO:976.

FIG. 11 shows some exemplary Fc domain sequences that are useful with the 2+1 $Fab_2$-scFv-Fc format. The "monomer 1" sequences depicted in FIG. 11 typically refer to the Fc domain of the "Fab-Fc heavy chain" and the "monomer 2" sequences refer to the Fc domain of the "Fab-scFv-Fc heavy chain." In addition, FIGS. 12-15 provides exemplary CH1-hinge domains, CH1 domains, and hinge domains that can be included in the first or second monomer of the 2+1 $Fab_2$-scFv-Fc format. Further, FIG. 16 provides useful CL sequences that can be used with this format. Exemplary anti-B7H3 x anti-CD28 bispecific antibodies in the 2+1 $Fab_2$-scFv-Fc format are depicted in FIG. 36.

3. 1+1 CLC Format

One heterodimeric antibody format that finds particular use in subject bispecific antibodies provided herein (e.g., anti-CD28 x anti-B7H3 antibody) is the "1+1 Common Light Chain" or "1+1 CLC" format, which is depicted in FIG. 33C. The 1+1 CLC format antibody includes a first monomer that includes a VH1-CH1-hinge-CH2-CH3, wherein VH1 is a first variable heavy domain and CH2-CH3 is a first Fc domain; a second monomer that includes a VH2-CH1-hinge-CH2-CH3, wherein VH2 is a second variable heavy domain and CH2-C3 is a second Fc domain; and a third monomer "common light chain" comprising VL-CL, wherein VL is a common variable light domain and CL is a constant light domain. In such embodiments, the VL pairs with the VH1 to form a first binding domain with a first antigen binding specificity; and the VL pairs with the VH2 to form a second binding domain with a second antigen binding specificity. In some embodiments, the 1+1 CLC format antibody is a bivalent antibody.

In some embodiments, the first and second Fc domains of the 1+1 CLC format are variant Fc domains that include heterodimerization skew variants (e.g., a set of amino acid substitutions as shown in FIGS. 3 and 9). Particularly useful heterodimerization skew variants include S364K/E357Q: L368D/K370S; L368D/K370S: S364K; L368E/K370S: S364K; T411T/E360E/Q362E: D401K; L368D/K370S: S364K/E357L; K370S: S364K/E357Q; T366S/L368A/Y407V: T366W and T366S/L368A/Y407V/Y349C: T366W/S354C (EU numbering). In exemplary embodiments, one of the first or second variant Fc domains includes heterodimerization skew variants L368D/K370S and the other of the first or second variant Fc domains includes heterodimerization skew variants S364K/E357Q, wherein numbering is according to EU numbering. In exemplary embodiments, the first variant Fc domain includes heterodimerization skew variants L368D/K370S and the second variant Fc domain includes heterodimerization skew variants S364K/E357Q, wherein numbering is according to EU numbering.

In some embodiments, the variant Fc domains include ablation variants (including those shown in FIG. 5). In some embodiments, each of the first and second variant Fc domains include ablation variants E233P/L234V/L235A/G236_/S267K, wherein numbering is according to EU numbering.

In some embodiments, the constant domain (CH1-hinge-CH2-CH3) of the first or second monomer includes pI variants (including those shown in FIG. 4). In exemplary embodiments, the constant domain (CH1-hinge-CH2-CH3) of the first or second monomer includes pI variants N208D/Q295E/N384D/Q418E/N421D, wherein numbering is according to EU numbering.

In some embodiments, the 1+1 CLC format antibody provided herein includes FcRn variants M428L/N434S, wherein numbering is according to EU numbering.

In exemplary embodiments, the first variant Fc domain includes heterodimerization skew variants L368D/K370S and the second variant Fc domain includes heterodimerization skew variants S364K/E357Q; each of the first and second variant Fc domains include ablation variants E233P/L234V/L235A/G236_/S267K; and the constant domain (CH1-hinge-CH2-CH3) of the first monomer includes pI variants N208D/Q295E/N384D/Q418E/N421D, wherein numbering is according to EU numbering.

In some embodiments, the CH1-hinge-CH2-CH3 of the first monomer comprises amino acid variants L368D/K370S/N208D/Q295E/N384D/Q418E/N421D/E233P/

L234V/L235A/G236del/S267 K, and the second Fc domain comprises amino acid variants S364K/E357Q/E233P/L234V/L235A/G236del/S267K, wherein numbering is according to EU numbering.

In some embodiments, the 1+1 CLC format antibody provided herein further includes FcRn variants M428L/N434S, wherein numbering is according to EU numbering.

In some embodiments, one of the first binding domain or the second binding domain binds CD28 and the other binding domain binds a tumor associated antigen (TAA) (see FIG. 34C). Any suitable CD28 binding domain can be included in subject 1+1 CLC format antibody, including any of the CD28 binding domains provided herein. In some embodiments, the CD28 binding domain is one of of the following CD28 binding domains or a variant thereof: 1A7[CD28]_H1.14L1, 1A7[CD28]_H1_L1.71, 1A7[CD28]_ H1.1_L1.71, 1A7[CD28]_H1.14_L1.71, CD28.3[CD28]_ H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1 (FIGS. 18-21 and 23 and Sequence Listing). In exemplary embodiments, the CD28 binding domain includes a 1A7[CD28]_H1.14 variable heavy domain. In some embodiments, the CD28 binding domain includes a 1A7[CD28]_H1.14 variable heavy domain or variant thereof and a light variable domain of any of the CD28 binding domains provided herein. In exemplary embodiments, the CD28 binding domain is 1A7[CD28]_H1.14L1 or a variant thereof. In some embodiments of the mAb-scFv format, the anti-CD28 ABD has a VH domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO: 1198, SEQ ID NO: 1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, one of the first binding domain or the second binding domain of the 1+1 CLC format antibody binds a tumor associated antigen (TAA). Suitable TAAs include any of the TAAs disclosed herein. In exemplary embodiments, the TAA is B7H3. Any suitable B7H3 binding domain can be included in subject 1+1 CLC format antibody, including any of the B7H3 binding domains provided herein. In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189[B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing).

In some embodiments, the anti-B7H3 ABD has a VL domain with an amino acid sequence selected from the group consisting of a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and a VL domain having the amino acid sequence selected from the group consisting of SEQ ID NO:874 and SEQ ID NO: 932.

In some embodiments, the anti-B7H3 ABD comprises a VH domain having the amino acid sequence of SEQ ID NO:946; and a variable light domain having the amino acid sequence of SEQ ID NO:950.

In some embodiments, the the anti-B7H3 ABD comprises a VH domain having the amino acid sequence of SEQ ID NO:956; and a variable light domain having the amino acid sequence of SEQ ID NO:960.

In some embodiments, the anti-B7H3 ABD comprises a VH domain having the amino acid sequence of SEQ ID NO:964; and a variable light domain having the amino acid sequence of SEQ ID NO:968.

In some embodiments, the anti-B7H3 ABD comprises a VH domain having the amino acid sequence of SEQ ID NO:972; and a variable light domain having the amino acid sequence of SEQ ID NO:976.

In some embodiments, the anti-B7H3 ABD has a VH domain and VL domain with amino acid sequences selected from the pairs of a) SEQ ID NOs: 89 and 93 from omburamab, b) SEQ ID NOs:97 and 101 from enoblituzumab, c) SEQ ID NOs:105 and 109 from BRCA84D, d) SEQ ID NOs:113 and 117 from BRCA69D, e) SEQ ID NOs:121 and 125 from PRCA157, f) SEQ ID NOs:129 and 133 from huPRCA157, g) SEQ ID NOs:137 and 141 from Mab-D; h) SEQ ID NOs:145 and 149 humAb-D; i) SEQ ID NOs:153 and 157 from m30; j) SEQ ID NOs:161 and 165 from M30-H1-L4, k) SEQ ID NOs:169 and 173 SP265; 1) SEQ ID NOs:177 and 181 from S10-H50L58; m) SEQ ID NOs:185 and 189 from 8H9, n) SEQ ID NOs:193 and 197 from m852; o) SEQ ID NOs:201 and 205 from m857; p) SEQ ID NOs:209 and 213 from m8524; q) SEQ ID NOs:217 and 221 from 1-1; r) SEQ ID NOs:225 and 229 from 1-2; s) SEQ ID NOs:233 and 237 from 1-4; t) SEQ ID NOs:241 and 245 from 1-5; u) SEQ ID NOs:249 and 253 from 1-7; v) SEQ ID NOs:257 and 261 from 2-5; w) SEQ ID NOs:265 and 269 from 2-8; x) SEQ ID NOs: 273 and 277 from chAb2; y) SEQ ID NOs:281 and 285 chAb3; z) SEQ ID NOs:289 and 293 from chAb4; aa) SEQ ID NOs:297 and 301 from chAb18; bb) SEQ ID NOs:305 and 309 from chAb13; cc) SEQ ID NOs:313 and 317 from chAb12; dd) SEQ ID NOs:321 and 325 from chAb14; ee) SEQ ID NOs:329 and 333 from chAb6; ff) SEQ ID NOs:337 and 341 from chAb11, gg) SEQ ID NOs:345 and 349 from chAB16; hh) SEQ ID NOs:353 and 357 from chAb10; ii) SEQ ID NOs:361 and 365 from ChAb7; jj) SEQ ID NOs: 369 and 373 from chAb8, kk) SEQ ID NOs:377 and 381 from chAb17; 11) SEQ ID NOs:385 and 389 from chAb5, mm) SEQ ID NOs:393 and 397 from huAb3v2.5, nn) SEQ ID NOs:401 and 405 from huAb3v2.6, pp) SEQ ID NOs:409 and 413 from huAb13v1, qq) SEQ ID NOs:417 and 421 from TPP-5706, rr) SEQ ID NOs:425 and 429 from TPP-6642; ss) SEQ ID NOs:433 and 437 from TPP-6850, tt) SEQ ID NOs:441 and 445 from TPP-3803, uu) SEQ ID NOs:449 and 453 from TRL4542, vv) SEQ ID NOs:457 and 461 from h1702, ww) SEQ ID NOs:465 and 469 from h1703, xx) SEQ ID NOs:473 and 477 from huA3, yy) SEQ ID NOs:481 and 485 from huA9 and zz) SEQ ID NOs: 489 and 493 from m1704. See FIG. 17 from U.S. Ser. No. 63/092,272.

In exemplary embodiments, the B7H3 binding domain includes a 1A7[CD28]_H1.14 variable heavy domain. In some embodiments, the B7H3 binding domain includes a 2E4A3.189[B7H3]_H1.22 variable heavy domain and a light variable domain of any of the CD28 or B7H3 binding domains provided herein. In exemplary embodiments, the B7H3 binding domain includes a 2E4A3.189[B7H3]_H1.22 variable heavy domain or a variant thereof and a 1A7 [CD28]_ L1 variable light domain or a variant thereof.

In some embodiments, the 1+1 CLC format antibody includes a first binding domain that binds CD28 and a second binding domain that binds B7H3. In particular embodiments, the variable heavy domain of the first binding domain (i.e., the CD28 binding domain) is a 1A7[CD28]_ H1.14 variable heavy domain or variant thereof. In some embodiments, the variable heavy domain of the second binding domain (i.e., the B7H3 binding domain) is a 2E4A3.189[B7H3]_H1.22 variable heavy domain or variant thereof. In some embodiments, the 1+1 CLC format antibody includes a common light chain that includes the variable light domain of any of the CD28 or B7H3 binding domains provided herein. In some embodiments, the variable light domain is a 1A7[CD28]_L1 variable light domain or a variant thereof. Exemplary anti-B7H3 x anti-CD28 bispecific antibodies in the 1+1 CLC format are depicted in FIG. 37.

4. 2+1 CLC Format

Another heterodimeric antibody format that finds particular use in subject bispecific antibodies provided herein (e.g., anti-CD28 x anti-B7H3 antibody) is the "2+1 Common Light Chain" or "2+1 CLC" format, which is depicted in FIG. 33D. The 2+1 CLC format includes a first monomer that includes a VH1-CH1-linker-VH1-CH1-hinge-CH2—CH3, wherein the VH1s are each a first variable heavy domain and CH2-CH3 is a first Fc domain; a second monomer that includes a VH2-CH1-hinge-CH2-CH3, wherein VH2 is a second variable heavy domain and CH2-CH3 is a second Fc domain; and a third monomer that includes a "common light chain" VL-CL, wherein VL is a common variable light domain and CL is a constant light domain. The VL pairs with each of the VH1s of the first monomer to form two first binding domains, each with a first antigen binding specificity; and the VL pairs with the VH2 to form a second binding domain with a second antigen binding specificity. The linker of the first monomer can be any suitable linker, including any one of the domain linkers or combinations thereof described in FIG. 7. In some embodiments, the linker is EPKSCGKPGSGKPGS (SEQ ID NO: 1182). In some embodiments, the 2+1 CLC format antibody is a trivalent antibody.

In some embodiments, the first and second Fc domains of the 2+1 CLC format are variant Fc domains that include heterodimerization skew variants (e.g., a set of amino acid substitutions as shown in FIGS. 3 and 9). Particularly useful heterodimerization skew variants include S364K/E357Q: L368D/K370S; L368D/K370S: S364K; L368E/K370S: S364K; T411T/E360E/Q362E: D401K; L368D/K370S: S364K/E357L; K370S: S364K/E357Q; T366S/L368A/

Y407V: T366W and T366S/L368A/Y407V/Y349C: T366W/S354C (EU numbering)). In exemplary embodiments, one of the first or second variant Fc domains includes heterodimerization skew variants L368D/K370S and the other of the first or second variant Fc domains includes heterodimerization skew variants S364K/E357Q, wherein numbering is according to EU numbering. In exemplary embodiments, the first variant Fc domain includes heterodimerization skew variants L368D/K370S and the second variant Fc domain includes heterodimerization skew variants S364K/E357Q, wherein numbering is according to EU numbering.

In some embodiments, the variant Fc domains include ablation variants (including those shown in FIG. 5). In some embodiments, each of the first and second variant Fc domains include ablation variants E233P/L234V/L235A/G236_/S267K, wherein numbering is according to EU numbering.

In some embodiments, the constant domain (CH1-hinge-CH2-CH3) of the first or second monomer includes pI variants (including those shown in FIG. 4). In exemplary embodiments, the constant domain (CH1-hinge-CH2-CH3) of the first or second monomer includes pI variants N208D/Q295E/N384D/Q418E/N421D, wherein numbering is according to EU numbering.

In some embodiments, the 2+1 CLC format antibody provided herein further includes FcRn variants M428L/N434S, wherein numbering is according to EU numbering.

In exemplary embodiments, the first variant Fc domain includes heterodimerization skew variants L368D/K370S and the second variant Fc domain includes heterodimerization skew variants S364K/E357Q; each of the first and second variant Fc domains include ablation variants E233P/L234V/L235A/G236_/S267K; and the constant domain (CH1-hinge-CH2-CH3) of the first monomer includes pI variants N208D/Q295E/N384D/Q418E/N421D, wherein numbering is according to EU numbering.

In some embodiments, the 2+1 CLC format antibody provided herein further includes FcRn variants M428L/N434S, wherein numbering is according to EU numbering.

In some embodiments, the CH1-hinge-CH2-CH3 of the second monomer comprises amino acid variants L368D/K370S/N208D/Q295E/N384D/Q418E/N421D/E233P/L234V/L235A/G236del/S267 K, and the first Fc domain comprises amino acid variants S364K/E357Q/E233P/L234V/L235A/G236del/S267K, wherein numbering is according to EU numbering.

In some embodiments, each of the two first binding domains binds a tumor associated antigen (TAA) and the second binding domain binds CD28 (see FIG. 34D). Any suitable CD28 binding domain can be included in the subject 2+1 CLC format antibody, including any of the CD28 binding domains provided herein. In some embodiments, the CD28 binding domain is one of the following CD28 binding domains or a variant thereof: 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, TGN1412_H1L1, 341VL34[CD28]_H1L1, 341VL36[CD28]_H1L1, 281VL4[CD28]_H1L1, HuTN228[CD28]_H1L1, PV1[CD28]_H0L0, m9.3[CD28]_H0L0, hu9.3[CD28]_H1L1 (FIGS. 18-21 and 23 and Sequence Listing). In exemplary embodiments, the CD28 binding domain includes a 1A7[CD28]_H1.14 variable heavy domain. In some embodiments, the CD28 binding domain includes a 1A7[CD28]_H1.14 variable heavy domain or variant thereof and a light variable domain of any of the CD28 binding domains provided herein. In exemplary embodiments, the CD28 binding domain is 1A7[CD28]_H1.14L1 or a variant thereof.

In some embodiments of the mAb-scFv format, the anti-CD28 ABD has a VH domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO: 1198, SEQ ID NO: 1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, each of the two first binding domains binds a tumor associated antigen (TAA). In certain embodiments, the two first binding domains bind the same TAA. Suitable TAAs include any of the TAAs disclosed herein. In exemplary embodiments, the TAA is B7H3. Any suitable B7H3 binding domain can be included in subject 2+1 CLC format antibody, including any of the B7H3 binding domains provided herein. In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189 [B7H3]_H1.22L1, 2E4A3.189[B7H3]_H1.22/1A7[CD28]_ L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing).

In some embodiments, the anti-B7H3 ABD has a VL domain with an amino acid sequence selected from the group consisting of a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and a VL domain having the amino acid sequence selected from the group consisting of SEQ ID NO:874 and SEQ ID NO: 932.

In some embodiments, the anti-B7H3 ABD comprises a VH domain having the amino acid sequence of SEQ ID NO:946; and a variable light domain having the amino acid sequence of SEQ ID NO:950.

In some embodiments, the the anti-B7H3 ABD comprises a VH domain having the amino acid sequence of SEQ ID NO:956; and a variable light domain having the amino acid sequence of SEQ ID NO:960.

In some embodiments, the anti-B7H3 ABD comprises a VH domain having the amino acid sequence of SEQ ID NO:964; and a variable light domain having the amino acid sequence of SEQ ID NO:968.

In some embodiments, the anti-B7H3 ABD comprises a VH domain having the amino acid sequence of SEQ ID NO:972; and a variable light domain having the amino acid sequence of SEQ ID NO:976.

In some embodiments, the anti-B7H3 ABD has a VH domain and VL domain with amino acid sequences selected from the pairs of a) SEQ ID NOs: 89 and 93 from omburamab, b) SEQ ID NOs:97 and 101 from enoblituzumab, c) SEQ ID NOs:105 and 109 from BRCA84D, d) SEQ ID NOs:113 and 117 from BRCA69D, e) SEQ ID NOs:121 and 125 from PRCA157, f) SEQ ID NOs:129 and 133 from huPRCA157, g) SEQ ID NOs:137 and 141 from Mab-D; h) SEQ ID NOs:145 and 149 humAb-D; i) SEQ ID NOs:153 and 157 from m30; j) SEQ ID NOs:161 and 165 from M30-H1-L4, k) SEQ ID NOs:169 and 173 SP265; 1) SEQ ID NOs:177 and 181 from S10-H50L58; m) SEQ ID NOs:185 and 189 from 8H9, n) SEQ ID NOs:193 and 197 from m852; o) SEQ ID NOs:201 and 205 from m857; p) SEQ ID NOs:209 and 213 from m8524; q) SEQ ID NOs:217 and 221 from 1-1; r) SEQ ID NOs:225 and 229 from 1-2; s) SEQ ID NOs:233 and 237 from 1-4; t) SEQ ID NOs:241 and 245 from 1-5; u) SEQ ID NOs:249 and 253 from 1-7; v) SEQ ID NOs:257 and 261 from 2-5; w) SEQ ID NOs:265 and 269 from 2-8; x) SEQ ID NOs: 273 and 277 from chAb2; y) SEQ ID NOs:281 and 285 chAb3; z) SEQ ID NOs:289 and 293 from chAb4; aa) SEQ ID NOs:297 and 301 from chAb18; bb) SEQ ID NOs:305 and 309 from chAb13; cc) SEQ ID NOs:313 and 317 from chAb12; dd) SEQ ID NOs:321 and 325 from chAb14; ee) SEQ ID NOs:329 and 333 from chAb6; ff) SEQ ID NOs:337 and 341 from chAb11, gg) SEQ ID NOs:345 and 349 from chAB16; hh) SEQ ID NOs:353 and 357 from chAb10; ii) SEQ ID NOs:361 and 365 from ChAb7; jj) SEQ ID NOs: 369 and 373 from chAb8, kk) SEQ ID NOs:377 and 381 from chAb17; 11) SEQ ID NOs:385 and 389 from chAb5, mm) SEQ ID NOs:393 and 397 from huAb3v2.5, nn) SEQ ID NOs:401 and 405 from huAb3v2.6, pp) SEQ ID NOs:409 and 413 from huAb13v1, qq) SEQ ID NOs:417 and 421 from TPP-5706, rr) SEQ ID NOs:425 and 429 from TPP-6642; ss) SEQ ID NOs:433 and 437 from TPP-6850, tt) SEQ ID NOs:441 and 445 from TPP-3803, uu) SEQ ID NOs:449 and 453 from TRL4542, vv) SEQ ID NOs:457 and 461 from h1702, ww) SEQ ID NOs:465 and 469 from h1703, xx) SEQ ID NOs:473 and 477 from huA3, yy) SEQ ID NOs:481 and 485 from huA9 and zz) SEQ ID NOs: 489 and 493 from m1704. See FIG. 17 from U.S. Ser. No. 63/092,272.

In exemplary embodiments, the B7H3 binding domain includes a 1A7[CD28]_H1.14 variable heavy domain. In some embodiments, the B7H3 binding domain includes a 2E4A3.189[B7H3]_H1.22 variable heavy domain and a light variable domain of any of the CD28 or B7H3 binding domains provided herein. In exemplary embodiments, the B7H3 binding domain includes a 2E4A3.189[B7H3]_H1.22 variable heavy domain or a variant thereof and a 1A7 [CD28]_ L1 variable light domain or a variant thereof.

In some embodiments, the 2+1 CLC format antibody includes two first binding domains that each bind B7H3 and a second binding domain that binds CD28. In some embodiments, the variable heavy domain of each of the first binding domains (i.e., the B7H3 binding domains) is a 2E4A3.189 [B7H3]_H1.22 variable heavy domain or variant thereof. In particular embodiments, the variable heavy domain of the second binding domain (i.e., the CD28 binding domain) is a 1A7[CD28]_H1.14 variable heavy domain or variant thereof. In some embodiments, the 2+1 CLC format antibody includes a common light chain that includes the variable light domain of any of the CD28 or B7H3 binding domains provided herein. In some embodiments, the variable light domain is a 1A7[CD28]_L1 variable light domain or a variant thereof. Exemplary anti-B7H3 x anti-CD28 bispecific antibodies in the 2+1 CLC format are depicted in FIG. 38.

FIG. 13 depicts sequences for "CH1+half hinge" domain linker that find use in embodiments of the 2+1 CLC format. In the 2+1 CLC format, the "CH1+half hinge" sequences find use linking the first variable heavy domain ($V_H$) to the second $V_H$domain on the Fab-Fab-Fc side of the bispecific antibody.

In some embodiments, the second monomer comprises the amino acid sequence of SEQ ID NO:1019, the first monomer comprises the amino acid sequence of SEQ ID NO:1020, and the light chain has the amino acid sequence of SEQ ID NO:1021.

5. 2+1 mAb-scFv Format

One heterodimeric antibody format that finds particular use in the subject bispecific antibodies provided herein (e.g., anti-CD28 x anti-B7H3 antibody) is the 2+1 mAb-scFv format shown in FIG. 33E. This antibody format includes three antigen binding domains: two Fab portions and an scFv that is attached to the C-terminal of one of the heavy chains. In some embodiments of this format, the Fab portions each bind a tumor associated antigen (TAA), in this case, human B7H3 and the "extra" scFv domain binds CD28. That is, this mAb-scFv format is a trivalent antibody.

In these embodiments, the first chain or monomer comprises, from N- to C-terminal, VH1-CH1-hinge-CH2-CH3, the second monomer comprises, from N- to C-terminal, VH1-CH1-hinge-CH2-CH3-domain linker-scFv domain, where the scFv domain comprises a second VH (VH2), a second VL (VL2) and a scFv linker. As for all the scFv domains herein, the scFv domain can be in either orientation, from N- to C-terminal, VH2-scFv linker-VL2 or VL2-scFv linker-VH2. Accordingly, the second monomer may comprise, from N- to C-terminal, VH1-CH1-hinge-CH2-CH3-domain linker-VH2-scFv linker-VL2 or VH1-CH1-hinge-CH2-CH3-domain linker-VL2-scFv linker-VH2. The composition also comprises a light chain, VL1-CL. In these embodiments, the VH1-VL1 each form a first ABD and the VH2-VL2 form a second ABD. In some embodiments, the first ABD binds to a tumor target antigen, including human B7H3, and the second ABD binds human CD28.

In some embodiments, the first and second Fc domains of the 2+1 mAb-scFv format antibody are variant Fc domains that include heterodimerization skew variants (e.g., a set of amino acid substitutions as shown in FIGS. 3 and 9). Particularly useful heterodimerization skew variants include S364K/E357Q: L368D/K370S; L368D/K370S: S364K; L368E/K370S: S364K; T411T/E360E/Q362E: D401K; L368D/K370S: S364K/E357L; K370S: S364K/E357Q; T366S/L368A/Y407V: T366W and T366S/L368A/Y407V/Y349C: T366W/S354C (EU numbering)). In exemplary embodiments, one of the first or second variant Fc domains includes heterodimerization skew variants L368D/K370S and the other of the first or second variant Fc domains includes heterodimerization skew variants S364K/E357Q, wherein numbering is according to EU numbering. In exemplary embodiments, the first variant Fc domain includes heterodimerization skew variants L368D/K370S and the second variant Fc domain includes heterodimerization skew variants S364K/E357Q, wherein numbering is according to EU numbering.

In some embodiments, the variant Fc domains include ablation variants (including those shown in FIG. 5). In some embodiments, each of the first and second variant Fc domains include ablation variants E233P/L234V/L235A/G236_/S267K, wherein numbering is according to EU numbering.

In some embodiments, the constant domain (CH1-hinge-CH2-CH3) of the first monomer includes pI variants (including those shown in FIG. 4). In exemplary embodiments, the constant domain (CH1-hinge-CH2-CH3) of the first monomer includes pI variants N208D/Q295E/N384D/Q418E/N421D, wherein numbering is according to EU numbering.

In some embodiments, the scFv of the 2+1 mAb-scFv format antibody provided herein includes a charged scFv linker (including those shown in FIG. 6). In some embodiments, the 2+1 mAb-scFv format antibody provided herein includes FcRn variants M428L/N434S, wherein numbering is according to EU numbering.

In exemplary embodiments, the first variant Fc domain includes heterodimerization skew variants L368D/K370S and the second variant Fc domain includes heterodimerization skew variants S364K/E357Q; each of the first and second variant Fc domains include ablation variants E233P/L234V/L235A/G236_/S267K; and the constant domain (CH1-hinge-CH2-CH3) of the first monomer includes pI variants N208D/Q295E/N384D/Q418E/N421D, wherein numbering is according to EU numbering.

In some embodiments, the scFv of the 2+1 mAb-scFv format antibody provided herein includes a $(GKPGS)_4$ charged scFv linker. In some embodiments, 2+1 mAb-scFv format antibody provided herein includes FcRn variants M428L/N434S, wherein numbering is according to EU numbering.

In some embodiments, the scFv of the second monomer of the 2+1 $Fab_2$-scFv-Fc format antibody is a CD28 binding and the VH1 of the first and second monomer and the VL1 of the common light chain each form binding domains that bind a tumor associated antigen (TAA, e.g., B7H3) (see FIG. 26B). Any suitable CD28 binding domain can be included in subject 2+1 mAb-scFv format antibody, including any of the CD28 binding domains provided herein. In some embodiments, the CD28 binding domain is one of the following CD28 binding domains or a variant thereof: 1A7[CD28]_H1L1, 1A7[CD28]_H1.14L1, 1A7[CD28]_H1_L1.71, 1A7[CD28]_H1.1_L1.71, 1A7[CD28]_H1.14_L1.71, CD28.3[CD28]_H0L0, TGN1412_H1L1, 341VL34[CD28]_ H1L1, 341VL36[CD28]_H1L1, 281VL4[CD28]_H1L1, HuTN228[CD28]_H1L1, PV1[CD28]_H0L0, m9.3[CD28]_ H0L0, hu9.3[CD28]_H1L1 (FIGS. 18-21 and 23 and Sequence Listing).

In some embodiments of the mAb-scFv format, the anti-CD28 ABD has a VH domain with an amino acid sequence selected from the group consisting of SEQ ID NO: 870, SEQ ID NO:585, SEQ ID NO:586, SEQ ID NO:587, SEQ ID NO:588, SEQ ID NO:589, SEQ ID NO:590, SEQ ID NO:591, SEQ ID NO:592, SEQ ID NO:593, SEQ ID NO:594, SEQ ID NO:595, SEQ ID NO:596, SEQ ID NO:597, SEQ ID NO:598, SEQ ID NO:599, SEQ ID NO:600, SEQ ID NO:601, SEQ ID NO:602, SEQ ID NO:603, SEQ ID NO:604, SEQ ID NO:605, SEQ ID NO:606, SEQ ID NO:607, SEQ ID NO:608, SEQ ID NO:609, SEQ ID NO:610, SEQ ID NO:611, SEQ ID NO:612, SEQ ID NO:613, SEQ ID NO:614, SEQ ID NO:615, SEQ ID NO:616, SEQ ID NO:617, SEQ ID NO:618, SEQ ID NO:619, SEQ ID NO:620, SEQ ID NO:621, SEQ ID NO:622, SEQ ID NO:623, SEQ ID NO:624, SEQ ID NO: 1198, SEQ ID NO: 1199, SEQ ID NO:625, SEQ ID NO:626, SEQ ID NO:627, SEQ ID NO:628, SEQ ID NO:629, SEQ ID NO:630, SEQ ID NO:631, SEQ ID NO:632, SEQ ID NO:633, SEQ ID NO:634, SEQ ID NO:635, SEQ ID NO:636, SEQ ID NO:637, SEQ ID NO:638, SEQ ID NO:639, SEQ ID NO:640, SEQ ID NO:641, SEQ ID NO:642, SEQ ID NO:643, SEQ ID NO:644, SEQ ID NO:645, SEQ ID NO:646, SEQ ID NO:647, SEQ ID NO:648, SEQ ID NO:649, SEQ ID NO:650, SEQ ID NO:651, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:670, SEQ ID NO:671 and SEQ ID NO:672, and a VL domain with an amino acid sequence selected from the group consisting of SEQ ID NO:874, SEQ ID NO:652, SEQ ID NO:653, SEQ ID NO:654, SEQ ID NO:655, SEQ ID NO:656, SEQ ID NO:657, SEQ ID NO:658, SEQ ID NO:659, SEQ ID NO:660, SEQ ID NO:661, SEQ ID NO:662, SEQ ID NO:663, SEQ ID NO:664, SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:1200 and SEQ ID NO:756.

In some embodiments, the VH1 of the first and second monomer and the VL1 of the common light chain of the 2+1 $Fab_2$-scFv-Fc format antibody each form a binding domain that binds a tumor associated antigen (TAA) (see FIG. 26B). Suitable TAAs include any of the TAAs disclosed herein. In exemplary embodiments, the TAA is B7H3. Any suitable B7H3 binding domain can be included in subject 2+1 $Fab_2$-scFv-Fc format antibody, including any of the B7H3 binding domains provided herein. In some embodiments, the B7H3 binding domain is one of the following B7H3 binding domains or a variant thereof: 2E4A3.189[B7H3]_H1L1, 2E4A3.189[B7H3]_H1/1A7[CD28]_L1, 2E4A3.189 [B7H3]_H1.22L1, 2E4A3.189[B7H3]_H1.22/1A7[CD28]_L1, 6A1[B7H3]_H1L1, omburtamab, enoblituzumab, BRCA84D, BRCA69D, PRCA157, huPRCA157, mAb-D, humAb-D, M30, M30-H1-L4, SP265, S10-H50L58, 8H9, m852, m857, m8524, 1-1, 1-2, 1-4, 1-5, 1-7, 2-5, 2-8, chAb2, chAb3, chAb4, chAb18, chAb13, chAb12, chAb14, chAb6, chAb11, chAb16, chAb10, chAb7, chAb8, chAb17, chAb5, huAb3v2.5, huAb3v2.6, huAb13v1, TPP-5706, TPP-6642, TPP-6850, TPP-3803, TRL4542, h1702, h1703, huA3, huA9, m1704 (FIGS. 26-31 and the Sequence Listing).

In some embodiments, the anti-B7H3 ABD has a VL domain with an amino acid sequence selected from the group consisting of a variable heavy domain with an amino acid sequence selected from the group consisting of SEQ ID NO:518, SEQ ID NO:928, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:509, SEQ ID NO:510, SEQ ID NO:511, SEQ ID NO:512, SEQ ID NO:513, SEQ ID NO:514, SEQ ID NO:515, SEQ ID NO:516, SEQ ID NO:517, SEQ ID NO:519, SEQ ID NO:520, SEQ ID NO:521, SEQ ID NO:522, SEQ ID NO:523, SEQ ID NO:524, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, SEQ ID NO:582, SEQ ID NO:583 and SEQ ID NO:584; and a VL domain having the amino acid sequence selected from the group consisting of SEQ ID NO:874 and SEQ ID NO: 932.

In some embodiments, the anti-B7H3 ABD comprises a VH domain having the amino acid sequence of SEQ ID NO:946; and a variable light domain having the amino acid sequence of SEQ ID NO:950.

In some embodiments, the the anti-B7H3 ABD comprises a VH domain having the amino acid sequence of SEQ ID NO:956; and a variable light domain having the amino acid sequence of SEQ ID NO:960.

In some embodiments, the anti-B7H3 ABD comprises a VH domain having the amino acid sequence of SEQ ID NO:964; and a variable light domain having the amino acid sequence of SEQ ID NO:968.

In some embodiments, the anti-B7H3 ABD comprises a VH domain having the amino acid sequence of SEQ ID NO:972; and a variable light domain having the amino acid sequence of SEQ ID NO:976.

FIGS. 10-11 show some exemplary Fc domain sequences that are useful with the 2+1 mAb-scFv format. The "monomer 1" sequences depicted in FIG. 10 typically refer to the Fc domain of the "Fab-Fc heavy chain" and the "monomer 2" sequences refer to the Fc domain of the "Fab-Fc-scFv" heavy chain." In addition, FIGS. 12-14 provides exemplary CH1 (optionally including hinge or half-hinge domains) that can be used in either the "Fab-Fc heavy chain" monomer or the the "Fab-Fc-scFv" heavy chain." FIG. 15 provides exemplary hinge domains that may be used in either the "Fab-Fc heavy chain" monomer or the the "Fab-Fc-scFv" heavy chain." Further, FIG. 16 provides useful CL sequences that can be used with this format.

6. Monospecific, Monoclonal Antibodies

As will be appreciated by those in the art, the novel Fv sequences outlined herein can also be used in both monospecific antibodies (e.g., "traditional monoclonal antibodies") or non-heterodimeric bispecific formats. Accordingly, the present invention provides monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H_L" designation can be linked to the constant region of a human IgG1 antibody.

In some embodiments, the monospecific antibody is a B7H3 monospecific antibody. In certain embodiments, the monospecific anti-B7H3 antibody includes the 6 CDRs of any of the following B7H3 antigen binding domains: 2E4A3.189[B7H3]_H1L1, 2E4A3.189[B7H3]_H1/1A7[CD28]_L1, 2E4A3.189[B7H3]_H1.22_L1, 2E4A3.189[B7H3]_H1.22/1A7[CD28]_L1, 6A1[B7H3]_H1L1, 3C4[B7H3]_H1L1.1, and 4F12[B7H3]_H2L1.1 (FIGS. 26-31). In some embodiments, the monospecific B7H3 antibody includes the variable heavy domain and variable light domain of any of the following B7H3 antigen binding domains: 2E4A3.189[B7H3]_H1L1, 2E4A3.189[B7H3]_H1/1A7[CD28]_L1, 2E4A3.189[B7H3]_H1.22_L1, 2E4A3.189[B7H3]_H1.22/1A7[CD28]_L1, 6A1[B7H3]_H1L1, 3C4[B7H3]_H1L1.1, and 4F12[B7H3]_H2L1.1 (FIGS. 26-31).

In some embodiments, the monospecific antibody is a CD28 monospecific antibody. In certain embodiments, the monospecific anti-CD28 antibody includes the 6 CDRs of any of the following CD28 antigen binding domains: 1A7[CD28]_H1L1, and 1A7[CD28]_H1.14_L1; (FIGS. 18 and 19). In some embodiments, the monospecific anti-CD28 antibody includes the variable heavy domain and variable light domain of any of the CD28 antigen binding domains: 1A7[CD28]_H1L1, and 1A7[CD28]_H1.14_L1 (FIGS. 18 and 19).

VI. Nucleic Acids

In another aspect, provided herein are nucleic acid compositions encoding the antigen binding domains and anti-B7H3 and anti-CD28 antibodies provided herein (e.g., αB37H3 x αCD28 bispecific antibodies).

As will be appreciated by those in the art, the nucleic acid compositions will depend on the format and scaffold of the heterodimeric protein. Thus, for example, when the format requires three amino acid sequences, such as for the 1+1 Fab-scFv-Fc or 2+1 $Fab_2$-scFv-Fc formats, 1+1 CLC and 2+1 CLC formats, three polynucleotides can be incorporated into one or more expression vectors for expression. In exemplary embodiments, each polynucleotide is incorporated into a different expression vector.

As is known in the art, the nucleic acids encoding the components of the binding domains and antibodies disclosed herein can be incorporated into expression vectors as is known in the art, and depending on the host cells used to produce the heterodimeric antibodies of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The polynucleotides and/or expression vectors of the invention are then transformed into any number of different types of host cells as is well known in the art, including mammalian, bacterial, yeast, insect and/or fungal cells, with mammalian cells (e.g., CHO cells), finding use in many embodiments.

In some embodiments, polynucleotides encoding each monomer are each contained within a single expression vector, generally under different or the same promoter controls. In embodiments of particular use in the present invention, each of these polynucleotides are contained on different expression vectors. As shown herein and in U.S. 62/025,931, hereby incorporated by reference, different vector ratios can be used to drive heterodimer formation. That is, surprisingly, while the proteins comprise first monomer: second monomer:light chains (in the case of many of the embodiments herein that have three polypeptides comprising the heterodimeric antibody) in a 1:1:2 ratio, these are not the ratios that give the best results.

The antibodies and ABDs provided herein are made by culturing host cells comprising the expression vector(s) as is well known in the art. Once produced, traditional antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "1+1 Fab-scFv-Fc" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

VII. Biological and Biochemical Functionality of the anti-CD28 x anti-TAA Antibodies Generally the bispecific anti-CD28 x anti-TAA antibodies described herein (e.g., anti-CD28 x anti-B7H3) are administered to patients with cancer (e.g., a B7H3 associated cancer), and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays.

A. Antibody Compositions for In Vivo Administration

Formulations of the antibodies used in accordance with the present invention are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™ PLURONICS™ or polyethylene glycol (PEG).

VIII. Treatments

Once made, the compositions of the invention find use in a number of oncology applications, by treating cancer, generally by enhancing immune responses (e.g., T cell activation and proliferation), particularly when used with anti-cancer therapies such as anti-PD1 and anti-tumor bispecific antibodies. In some embodiments, the antibodies provided herein enhance immune responses (e.g., T cell activation and proliferation) by providing agonistic co-stimulation of T cells in the microenvironment of tumors expressing a TAA of interest (e.g., B7H3).

In some embodiments, the anti-CD28 x anti-TAA bispecific antibodies provided herein are administered with an anti-tumor therapy including, for example, a checkpoint inhibitor (e.g., anti-PD1 antibody) or anti-tumor bispecific antibodies.

A. Anti-CD28 x Anti-TAA/Anti-TAA Bispecific Antibody

In some embodiments, the anti-CD28 x anti-TAA bispecific antibodies provided herein are administered with an anti-tumor bispecific antibody that is a T-cell engaging bispecific antibody, such as those that bind to human Cd3.

In classic T cell/APC interaction, there is a first signal provided by TCR reactivity with peptide-MHC (Signal 1) and a second signal provided by CD28 crosslinking by CD80/CD86 being expressed on APCs (Signal 2) which together fully activate T cells (see FIG. 31A). In contrast, only the first signal is provided in treatment with CD3 bispecific antibodies that target a TAA (i.e., anti-CD3 x anti-TAA bispecific antibodies).

Without being bound by any particular theory of operation, it is believed that the anti-CD28 x anti-TAA bispecific antibodies provided herein can enhance the anti-tumor response of an anti-CD3 x anti-TAA bispecific antibody by CD28 costimulation (see FIG. 31B and Examples 4E and 4F). Thus, in one aspect, provided herein are methods of methods of treating a cancer in a patient by administering the patient an anti-CD3 x anti-TAA bispecific antibody and an anti-CD28 x anti-TAA bispecific antibody provided herein. In some cases, the TTA is the same in both antibodies; thus, for example, there can be co-administration of an anti-CD28 x B7H3 bispecific antibody with an anti-CD3 x B7H3 antibody. In some cases, the TTAs are different. In some embodiments, the administration of the anti-CD3 x anti-TAA bispecific antibody and anti-CD28 x anti-TAA bispecific antibody enhances an immune response against the tumor in the patient. In some embodiments, the anti-CD3 x anti-TAA bispecific antibody and anti-CD28 x anti-TAA binds to different TAAs on the same tumor. In exemplary embodiments, the anti-CD28 x anti-TAA is an anti-CD28 x anti-B7H3 antibody provided herein.

B. Anti-CD28 x Anti-TTA/Checkpoint Inhibitor

In some embodiments, the anti-CD28 x anti-TAA bispecific antibodies provided herein are administered with a checkpoint inhibitor (e.g., anti-PD1 antibody). Without being bound by any particular theory of operation, it is believed that checkpoint blockade (e.g. PD-1 blockade) is a useful therapeutic modality to stack with engagement of T cell costimulatory receptors on TILs with agonistic anti-CD28 x anti-TAA bispecific antibodies as it would provide broad utility in solid tumors and circumvent CTLA4 inhibition of the CD28 pathway. Thus, in another aspect provided herein is a method of treating a cancer in a patient by administering the patient an anti-CD28 x anti-TAA bispecific antibody provided herein and a checkpoint inhibitor. In some embodiments, the administration of the anti-CD28 x anti-TAA bispecific antibody and checkpoint inhibitor enhances an immune response against the tumor in the patient. In some embodiments, the checkpoint inhibitor is a PD-1, PD-L1, or CTLA4 inhibitor. In exemplary embodiments, the PD-1 inhibitor is an anti-PD-1, anti-PD-L1 or anti-CTLA4 antibody.

C. Administrative Modalities

The antibodies provided herein administered to a subject, in accord with known methods, such as intravenous administration as a bolus or by continuous infusion over a period of time.

D. Treatment Modalities

In the methods of the invention, therapy is used to provide a positive therapeutic response with respect to a disease or condition.

By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies used in the present invention depend on the disease or condition to be treated and may be determined by the persons skilled in the art.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein.

BACKGROUND

While checkpoint blockade immunotherapies have proven to be effective, many patients nonetheless fail to achieve a response. Engagement of T cell costimulatory receptors on TILs with agonistic antibodies could provide an additional positive signal capable of overcoming negative signals of immune checkpoints and may be a useful therapeutic modality to stack with checkpoint blockade. However, systemic agonism of costimulatory receptors may nonetheless result in systemic toxicity. B7H3 has been found to be broadly overexpressed in cancer cells and tumor vascular cells and may be useful as a tumor target. Accordingly, αB7H3 x αCD28 bispecific antibodies (bsAbs) were engineered with the aim to target agonistic CD28 binding domains to the tumor environment thereby reducing the potential for systemic toxicity.

Example 1: CD28 Binding Domains

1A: Novel CD28 Binding Domains

An approach considered to avoid the superagonism associated with TGN1412 was to generate novel CD28 binding domains having lower affinity binding to CD28 and/or binding to a different CD28 epitope than TGN1412. In one campaign to generate such novel CD28 binding domains, in-house de novo phage libraries were panned against CD28. In another campaign, rat hybridomas were used to generate additional CD28 binding domains.

1A(a): Phage-Derived Clone 1A7

It should be noted that this phage library utilized a human germline VL with diversity introduced into the LCDR3. The amino acid sequences for exemplary phage-derived clone 1A7 are depicted in FIG. 18.

The phage-derived clones were formatted as bivalent mAbs to investigate their binding characteristics. Plasmids containing the variable heavy and variable light domains of select clones were constructed by Gibson assembly and subcloned into a pTT5 expression vector containing the coding sequence for the IgG1 constant regions (with E233P/L234V/L235A/G236del/S67K ablation variants). DNA was transfected in HEK293E for expression and resulting bivalent mAbs were purified from the supernatant using protein A chromatography.

Affinity of the phage-derived bivalent mAbs for CD28 was screened using Octet, a BioLayer Interferometry (BLI)-based method. Experimental steps for Octet generally include the following: Immobilization (capture of ligand to a biosensor); Association(dipping of ligand-coated biosensors into wells containing the analyte); and Dissociation (returning of biosensors to well containing buffer). The resulting apparent dissociation constant ($KD_{app}$) are depicted in FIG. 24 for XENP28428 (based on clone 1A7) and additional phage-derived comparators.

Binding of the phage-derived bivalent mAbs to cell-surface CD28 was investigated. Human PBMCs were incubated with indicated concentrations of XENP28428 or comparator phage-derived mAbs for 1 hour at 4° C. Cells were then then stained with Alexa Fluor® 647 AffiniPure $F(ab')_2$ Fragment Goat Anti-Human IgG, Fcγ fragment specific secondary antibody (Jackson ImmunoResearch, West Grove, Penn.) for 1 hour at 4° C. and analyzed by flow cytometry. The data (FIG. 25) show that the phage-derived mAbs were able to bind human PBMCs, although with much weaker maximum binding than prior art anti-CD28 mAb HuTN228 (XENP27181, sequences for which are depicted in FIG. 23).

In view of the weaker CD28 binding, 1A7 was further affinity engineered by introducing substitutions into the VH and/or VL. Sequences for such affinity engineered VH and VL regions are depicted as SEQ ID NOS: 585-756 (with illustrative sequences depicted in FIGS. 19-20); and sequences for illustrative affinity engineered VH/VL pairs are depicted in FIG. 21. Consensus sequences for the FR and CDRs are depicted in FIG. 44. Affinity for illustrative affinity engineered 1A7 VH/VL pairs for CD28 are depicted in FIG. 22.

Notably, the orientation of the VH and VL domains in the context of an scFv affects the binding affinity. Additionally, formatting the VH and VL domains in the context of a Fab domain (for use in common light chain bispecific mAb formats) as opposed to scFv also affects the binding affinity.

1B: Additional CD28 Binding Domains

VH, VL, and CDR sequences for additional CD28 binding domains which may find use in the αB7H3 x αCD28 bsAbs of the invention are depicted as SEQ ID NOs: 1-88.

Example 2: B7H3 Binding Domains

2A: Novel B7H3 Binding Domain

In one campaign to generate novel B7H3 binding domains, in-house de novo phage libraries were panned against B7H3. In another campaign, rat hybridomas were used to generate additional B7H3 binding domains.

2A(a): Phage-Derived Clone 2E4A3.189

It should be noted that this phage library was intended to discover binding domains suitable for use in common light chain bispecific antibody formats. Accordingly, it utilized the same human germline VL as in Example 1A(a) except without any diversity. The amino acid sequences for exemplary phage-derived clone 2E4A3.189 are depicted in FIG. 26. While this phage-derived clone is useful for enabling common light chain bispecific antibody formats, it had very weak binding affinity for B7H3 and required affinity engineering. As will be further described in Example 3B, the VH of 2E4A3.189 pairs productively with the VL of 1A7, but the VH of 1A7 does not pair productively with the VL of 2E4A3.189 (despite one amino acid difference). Accordingly to improve affinity, 2E4A3.189 was engineered with substitutions into the VH only, sequences for which are depicted as SEQ ID NOS: 497-584 and in FIG. 27, and paired with the VL of 1A7. Consensus sequences for the FR and CDRs are depicted in FIG. 75.

2B: Hybridoma-Derived Clones

B7H3 binding domains were obtained from rat and rabbit hybridoma and humanized using string content optimization (see, e.g., U.S. Pat. No. 7,657,380, issued Feb. 2, 2010). The amino acid sequences for exemplary humanized rat hybridoma-derived clones 6A1 and 3C4 and humanized rabbit hybridoma-derived clones 4F12 and 38E2 are depicted respectively in FIGS. 28-31. Binding affinities of the hybridoma clones (and affinity-engineered 2E4A3.189 phage clone) for human and cynomolgus B7H3 were determined in the context of 1+1 bsAb format (to obtain monovalent binding affinities), data for which are depicted in FIG. 32.

2C: Additional B7H3 Binding Domains

VH, VL, and CDR sequences for additional B7H3 binding domains which may find use in the B7H3 x CD28 bsAbs of the invention are depicted as SEQ ID NOs: 89-96.

Example 3: Engineering αB7H3 x αCD28 bsAbs

A number of formats for B7H3 x CD28 bsAbs were conceived, illustrative formats for which are outlined below and in FIG. 33. It should be noted that in each case, the CD28 bispecific antibodies are monovalent for CD28 and incorporate Fc variants to engineered to ablate FcγR binding (such as those depicted in FIG. 5) to avoid potential superagonism.

3A: Fab-scFv-Fc Formats

3A(a): 1+1 Fab-scFv-Fc format

One format utilizing Fab domains and scFv is the 1+1 Fab-scFv-Fc format (depicted schematically in FIG. 34A) which comprises a first monomer comprising a single-chain Fv ("scFv") with a first antigen binding specificity covalently attached to a first heterodimeric Fc domain, a second monomer comprising a heavy chain variable region (VH) covalently attached to a complementary second heterodimeric Fc domain, and a light chain (LC) transfected separately so that a Fab domain having a second antigen binding specificity is formed with the variable heavy domain. Sequences for illustrative αB7H3 x αCD28 bsAbs (based on binding domains as described in Examples 1 and 2) in the 1+1 Fab-scFv-Fc format are depicted in FIG. 35.

3A(b): 2+1 $Fab_2$-scFv-Fc Format

Another such format is the 2+1 $Fab_2$-scFv-Fc format (depicted schematically in FIG. 34B) which comprises a first monomer comprising a VH domain covalently attached to an scFv (having a first antigen binding specificity) covalently attached to a first heterodimeric Fc domain, a second monomer comprising a VH domain covalently attached to a complementary second heterodimeric Fc domain, and a LC transfected separately so that Fab domains having a second antigen binding specificity are formed with the VH domains. Sequences for illustrative αB7H3 x αCD28 bsAbs (based on binding domains as described in Examples 1 and 2) in the 2+1 $Fab_2$-scFv-Fc format are depicted in FIG. 36.

3B: Common Light Chain Format

As described above in Examples 1 and 2, the phage library for discovering CD28 and B7H3 binding domains utilized the same human germline VL, although the CD28 library included diversity in the LCDR3. It was found that the variable light domain of clone 1A7 differed from the variable light domain of anti-B7H3 clone 2E4A3.189 by only a single amino acid in the LCDR3. Accordingly, the possible use of clone 1A7 and clone 2E4A3.189 in a Common Light Chain construct was considered. However, it was surprisingly found that the VH of 2E4A3.189 paired productively with the VL of 1A7, but the VH of 1A7 did not pair productively with the VL of 2E4A3.189 despite only having one amino acid difference in the LCDR3. Further, as noted above, the phage-derived clone 1A7 demonstrated much weaker binding than prior art anti-CD28 mAb HuTN228 providing an opportunity for affinity-optimization. Accordingly, affinity-optimization libraries were generated with focus first on substitutions only in the variable heavy domains of 1A7 and 2E4A3.189. The amino acid sequences for exemplary affinity-optimized 1A7 variable domains H1.1 and H1.14 and affinity-optimized 2E4A3.189 variable heavy domain H1.3 and H1.22 are depicted respectively in FIGS. 19 and 27.

3B(a): 1+1 Common Light Chain Format

One common light chain format is the 1+1 Common Light Chain (CLC) format (depicted schematically in FIG. 34C) which comprises a first monomer comprising VH1-CH1-hinge-CH2-CH3, a second monomer comprising VH2-CH1-hinge-CH2-CH3, and a third monomer comprising VL-CL. The VL pairs with the VH1 to form a binding domain with a first antigen binding specificity; and the VL pairs with the VH2 to form a binding domain with a second antigen binding specificity. Sequences for illustrative αB7H3 x αCD28 bsAbs (based on binding domains as described here) in the 1+1 CLC format are depicted in FIG. 37.

3B(b): 2+1 Common Light Chain Format

Another common light chain format is the 2+1 CLC format (depicted schematically in FIG. 34D) which comprises a first monomer comprising VH1-CH1-hinge-VH1—CH1-hinge-CH2-CH3, a second monomer comprising VH2-CH1-hinge-CH2-CH3, and a third monomer comprising VL-CL. The VL pairs with the first and second VH1 to form binding domains with a first antigen binding specificity; and the VL pairs with the VH2 to form a binding domain with a second antigen binding specificity. Sequences for illustrative αB7H3 x αCD28 bsAbs (based on binding domains as described here) in the 2+1 CLC format are depicted in FIG. 38.

3C: 2+1 mAb-scFv format

An additional format utilizing Fab domains and scFv is the 2+1 mAb-scFv format (depicted schematically in FIG. 34E) which comprises a first monomer comprising a VH domain covalently attached to a first heterodimeric Fc domain covalently attached to an scFv (having a first antigen binding specificity), a second monomer comprising a VH domain covalently attached to a complementary second heterodimeric Fc domain, and a LC transfected separately so that Fab domains having a second antigen specificity are formed with the VH domains. Sequences for illustrative αB7H3 x αCD28 bsAbs (based on binding domains as described here) in the 2+1 mAb-scFv format are depicted in FIG. 39.

Example 4: Developing B7H3 x CD28 bsAbs

In classic T cell/APC interaction, there is a first signal provided by TCR reactivity with peptide-MHC (Signal 1) and a second signal provided by CD28 crosslinking by CD80/CD86 being expressed on APCs (Signal 2) which together fully activate T cells (see FIG. 40A). In contrast in treatment with CD3 bispecifics, only the first signal is provided. In some settings such as treatment of solid tumors, it might be useful to build in the CD28 signal which may be provided by a CD28 bispecific with the idea to promote activation and proliferation through CD28 costimulation (see FIG. 40B). Alternatively, where Signal 1 is already provided by endogenous TCR reactivity with neoepitopes, providing just Signal 2 with a CD28 bispecific antibody may be sufficient to enhance anti-tumor activity. It may nonetheless be useful to stack the CD28 signal with checkpoint blockade to mitigate any checkpoint mediated repression of the added CD28 signal (FIG. 41). The following sections characterize B7H3 x CD28 bispecific antibodies of the invention in the context of the foregoing. In this section, B7H3 x CD28 bsAbs were engineered in various formats and with various binding domains with an aim to optimize therapeutic properties.

4A: Tuning B7H3 x CD28 bsAb activity

The activity of 1+1 CD28 bispecific formats having monovalent binding to the tumor-associated antigen was compared against the activity of 2+1 CD28 bispecific formats having bivalent binding to the tumor-associated antigen. 50,000 $CD3^+$ T cells were incubated with A549 or SKOV-3 cancer cells as a 10:1 effector:target ratio and treated with a dose titration of the indicated B7H3 x CD28 antibodies and plate bound 1 μg/mL plate-bound CD3 antibody (OKT3). 1 day post T cell seeding, cytokines were measured using MSD assay (Meso Scale Discovery, Rockville, Md.). The data depicted in FIG. 42 show that both the B7H3 x CD28 bispecific antibodies induced cytokine release by the T cells. Notably, XENP34339 having bivalent B7H3 binding induced cytokine release more potently than XENP34717 having monovalent B7H3 binding. It should be noted that the difference in potency is less pronounced when using B7H3 binding domains having higher affinity binding (data not shown).

In another experiment, the impact of CD28 binding affinity on activity was investigated. MCF7 cancer cell (transfected to express anti-CD3 scFv in order to provide the "Signal 1") were incubated with effector cells at a 1:1 effector:target ratio and the indicated concentrations of XENP34339, XENP35612, XENP35611, and XENP34336. Each of the bsAbs were in the 2+1 CLC format. XENP34339, XENP35612, and XENP35611 each included the 2E4A3.189_H1.22_1A7_L1 B7H3 binding domain while XENP34336 included the lower affinity 2E4A3.189_H1.3_1A7_L1 B7H3 binding domain. XENP34339, XENP35612, XENP35611, and XENP34336 respectively included CD28 binding domains having 77 nM, 270 nM, 610 nM, and 440 nM binding affinity. The data as depicted in FIG. 43 show that increased affinity for CD28 enhances potency of the B7H3 x CD28 bsAb.

In another set of experiments, the activity of a panel of B7H3 x CD28 bsAbs in the presence of additional cancer cells was investigated. $CD3^+$ T cells were incubated with MDA-MB-2331, LnCAP, or DU145 cancer cells at 1:1 E:T ratio, a constant dose of an illustrative B7H33 x CD3 bsAb, and dose titration of B7H3 x CD28 bsAbs. Data are depicted in FIG. 43. Consistent with the above, increased affinity for CD28 enhances potency of the B7H3 x CD28 bsAb (XENP34398>XENP37808). Additionally, the data also indicate that increased affinity for B7H3 enhances potency of the B7H3 x CD28 bsAb (e.g. XENP34398>XENP37810; XENP35151 and XENP35153>XENP34732; and XENP37807>XENP37982). Additionally, the data indicate that the 2+1 CLC format is more potent in enhancing IL-2 secretion in comparison to the 2+1 mAb-scFv format (XENP34398>XENP37807).

4B: Tuning CD28 bsAb Pharmacokinetic Profile

Next, the pharmacokinetic profile of various B7H3 x CD28 bsAbs of the invention were investigated.

In a first study, the pharmacokinetics of XENP34398 (having the 2+1 CLC format), XENP36781 (having the 2+1 mAb-scFv format), and XENP34395 (having the 2+1 central scFv format) were all tested in cynomolgus at a range of dosing levels. As depicted in FIG. 45, XENP34398 in the 2+1 CLC format was found to have significantly better pharmacokinetics than the 2+1 mAb-scFv format which was in turn slightly better than the 2+1 $Fab_2$-scFv-Fc format, at each dose level tested. Although there were other differences between these molecules in addition to the format (e.g. differences in the B7H3 binding domain), the data suggest the 2+1 CLC format may be advantageous in the context of B7H3 x CD28 bsAbs.

Figures 46A, 46B, 46C, 46D:
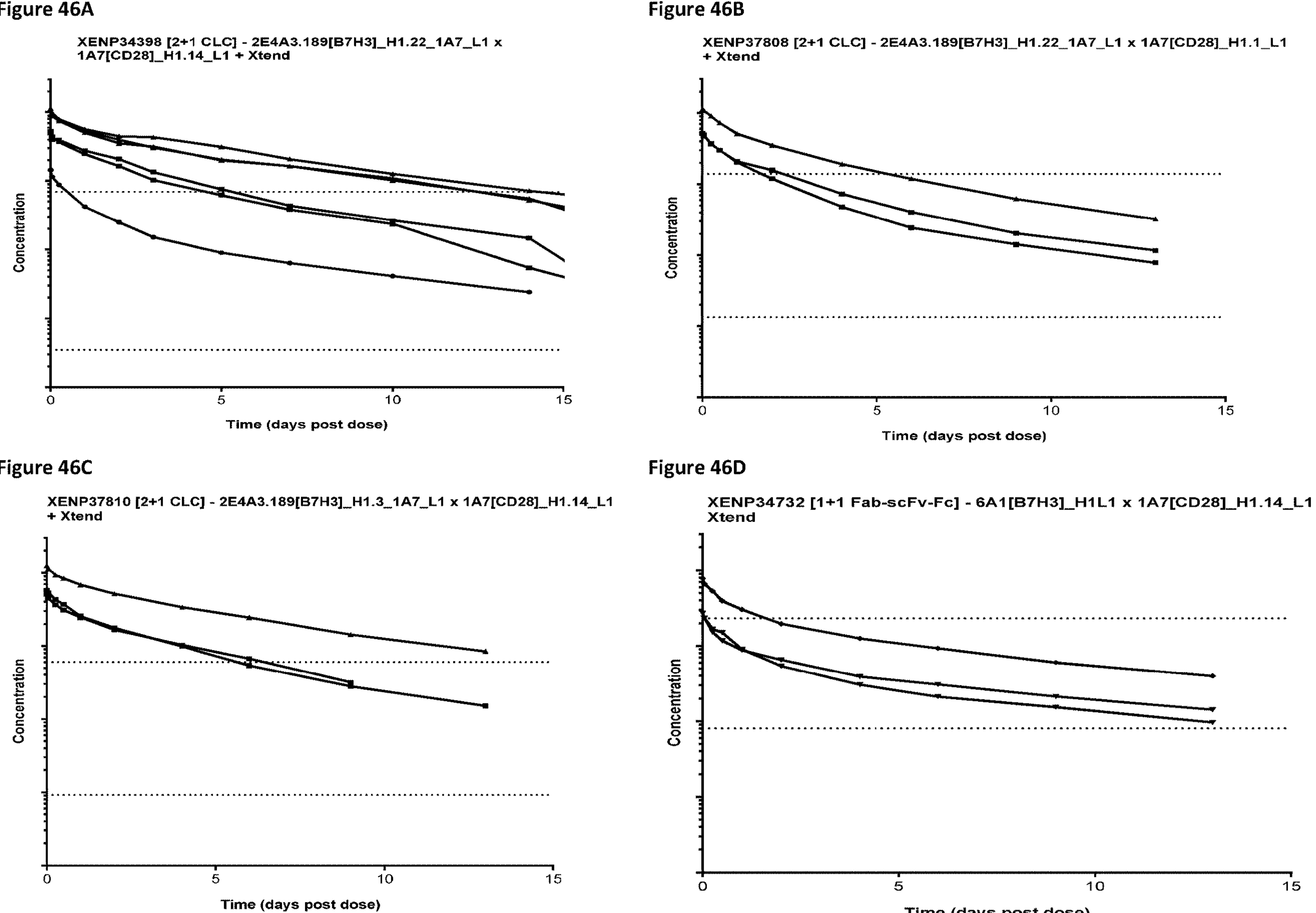
Figures 46E, 46F, 46G, 46H:
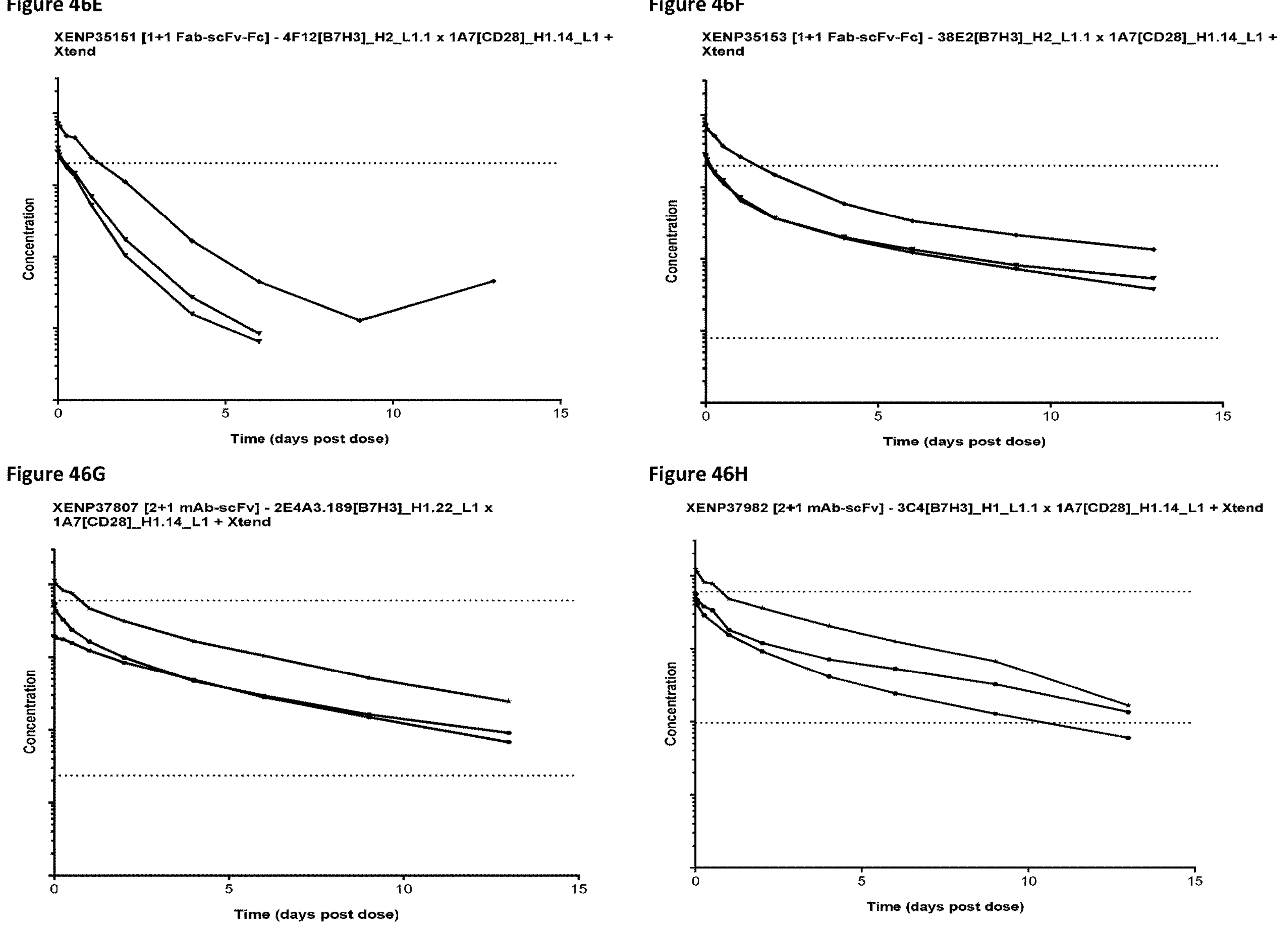

Additional B7H3 x CD28 bsAbs were engineered with the various B7H3 binding domains (and it various formats) as described in Example 2 and pharmacokinetic profiles were investigated in another cynomolgus study. FIG. 46A-C depicts a comparison XENP34398, XENP37808 and XENP37810, each of which are bsAbs in the 2+1 CLC format. XENP34398 and XENP37810 have the same CD28 binding domain (1A7_H1.14_L1 Fab) but different affinity B7H3 binding domains (based on the same phage-derived clone, but the variant in XENP34398 had higher affinity B7H3 binding than the variant in XENP37810). XENP34398 and XENP37808 have the same B7H3 binding domain (2E4A3.189_H1.22_1A7_L1) but different affinity CD28 binding domains (based on 1A7, but the variant in XENP34398 had tighter binding affinity than the variant in XENP37808). FIG. 46D-F depicts a comparison of XENP34732, XENP35151, and XENP35153, each of which are bsAbs in the 1+1 Fab-scFv-Fc format and having the same CD28 binding domain (1A7_H1.14_L1 scFv) but different B7H3 binding domains (respectively, 6A1, 4F12, and 38E2). The data show that each of the 3 molecules having different B7H3 binding domains had differing PK profiles despite being otherwise identical. In particular, XENP35151 (having 4F12 binding domain which as described in Example 2B has much tighter binding affinity than either 6A1 and 38E2) demonstrated worse PK profile in comparison to both XENP34732 and XENP35153 (respectively having 6A1 and 38E2 binding domains). This suggests that at least in the 1+1 format, the binding affinity for B7H3 may impact pharmacokinetic profile. FIGS. 46G-H depicts comparison of XENP37807 and XENP37982, each of which are bsAbs in the 2+1 mAb-scFv format and having the same CD28 binding domain (1A7_H1.14_L1 scFv) but different B7H3 binding domains (respectively 2E4 and 3C4).

4C: Summary of Select B7H3 x CD28 bsAbs

FIG. 47 depicts a summary of properties of several of the B7H3 x CD28 bsAbs of the invention. It should be noted that some of the data depicted in this summary table may not be the same experimental data depicted elsewhere in the Working Examples as some of those illustrate experimental data from earlier stages of development.

Example 5: Additional Characterization of Illustrative B7H3 x CD28 Bispecific Antibodies Illustrative B7H3 x CD28 bsAbs XENP34339 (or Xtend analog XENP34398) and XENP35612 (or Xtend analog XENP37808) were further characterized to generally demonstrate useful properties of the B7H3 x CD28 bispecific antibodies of the invention.

5A: XENP34339 restores CD28 signaling

CTLA-4 is an immune checkpoint receptor that competes with CD28 for CD28 ligands CD80 and CD86; therefore, in the presence of CTLA-4 (as would be found in the tumor environment), CD28 signaling is dampened. Restoration of CD28 signaling by the CD28 bispecific antibodies of the invention were investigated in a mixed lymphocyte reaction. 100,000 CD3$^+$ T cells were incubated with 10,000 dendritic cells (STEMCELL Technologies, Vancouver, Canada) having high B7H3 expression and 1 g/mL CTLA-4-Fc were treated with a dose titration of B7H3 x CD28 bispecific antibody XENP34339. 3 days post T cell seeding, cytokines were measured using MSD assay. The data as depicted in FIG. 48 show that XENP34339 enables endogenous CD28 signaling levels (i.e. absent introduced blockade by CTLA-4-Fc).

5B: XENP34339 Combines Productively with PD-1 Blockade

Checkpoint blockade (e.g. PD-1 blockade) may be a useful therapeutic modality to stack with engagement of T cell costimulatory receptors on TILs with agonistic antibodies as it would provide broad utility in solid tumors and circumvent CTLA4 inhibition of CD28 pathway. Accordingly, the combination of B7H3 x CD28 bispecific antibodies XENP34339 and XENP34389 with XENP16432 (a bivalent anti-PD-1 mAb based on the variable regions of nivolumab; sequences depicted in FIG. 17) was investigated. 10,000 MDA-MB-231 cancer cells were treated with 100 ng/ml HLA-A2*0201 restricted CMV pp65 (NLVPMVATV) peptide (NLV peptide) overnight. The following day, 100,000 CD3 enriched cells from a CMV+ donor were added along with XENP16432 (PD-1 blockade; 10 g/ml), XENP34339 (B7H3 x CD28 in 2+1 CLC format with B7H3 binding domain based on 2E4A3.189 and CD28 binding domain based on 1A7; 1 μg/ml), XENP34389 (B7H3×CD28 in 2+1 Fab$_2$-scFv-Fc format with B7H3 binding domain based on 6A1 and CD28 binding domain based on 1A7; 1 g/ml), and combinations of the B7H3 x CD28 with XENP16432. 1 day after treatment, cell supernatant was assayed for cytokines using MSD assay (data for which are shown in FIG. 50 for experiments using CD3$^+$ T cells from 2 different donors). The data show that incubation with XENP34339 alone induced cytokine release from T cells and combined synergistically with PD-1 blockade to enhance cytokine release. Notably, XENP34389 (2+1 Fab$_2$-scFv-Fc format) did not combine synergistically with PD-1 blockade. In a similar experiment, 20,000 MCF7 cancer cells were seeded in the presence of 100 ng/mL NLV peptide. After 24 hours, 200,000 CD3$^+$ T cells (10:1 E:T) isolated from a CMV+ PBMC donor and the test articles (PBS control, XENP34339 alone, PD-1 mAb XENP16432 alone, or XENP34339+XENP16432) were added. After 6 days, cells were assessed via flow cytometry. Consistent with the above, the data depicted in FIG. 51 PD-1 blockade enhances expansion of NLV-tetramer positive CD8$^+$ T cells by XENP34339.

To investigate whether the difference observed for XENP34339 resulted from the difference in B7H3 binding domain or the difference in bispecific antibody format, the component binding domains of XENP34339 and XENP34389 were biophysically characterized using Octet. In a first experiment to determine the binding affinities of 2E4A3.189 and 6A1 for B7H3 antigen, XENP34339 and XENP34389 were reformatted to monovalently bind to B7H3 antigen (respectively as XENP34717 and XENP34728, sequences for which are depicted in FIGS. 37 and 36). Anti-mouse Fc biosensors were used to capture mouse Fc fusions of B7H3, either the full extracellular V1C1-V2V2 domain or the individual V1C1 or V2C2 domains, and dipped into multiple concentrations of XENP34717 or XENP34728. Kinetic analyses were performed by global fitting of binding data with a 1:1 Langmuir binding model. The resulting dissociation constant (KD) are depicted in FIG. 52, and the data show that the 6A1 binding domain provided slightly tighter binding to B7H3 than the 2E4A3.189. Next, the binding affinities of the CD28 binding domains for CD28 antigen in the 2+1 CLC format and the 2+1 Fab2-scFv-Fc format was investigated. Anti-HIS capture (HIS1K) biosensors were used to capture CD28-Fc-His protein and dipped into multiple concentrations of XENP34339 or XENP34389. Kinetic analyses were performed by global fitting of binding data with a 1:1 Langmuir binding model as well as steady state model. The resulting dissociation constant (KD) are depicted in FIG. 53. The data show that the 2+1 CLC format enabled much tighter binding to CD28 antigen than the 2+1 $Fab_2$-scFc-Fc format. Collectively, the data suggests that the differences observed in the activity of XENP34339 and XENP34389 were due to the differences in bispecific antibody format.

5C: XENP34339 Overcomes Cancer Cell Resistance to CD3 Bispecifics at Low Effector to Target Ratios It has been reported in literature that non-inflamed, cold tumors such as prostate cancer have low effector:target ratio. Accordingly, cell kill at a 1:1 effector:target was assessed using xCELLigence Real Time Cell Analysis instrument (ACEA Biosciences, San Diego, CA). 2,500 LNCaP cancer cells were first seeded. After 48 hours, freshly enriched CD3+ T cells at an effector:target of 1:1 were added along with antibodies (αPSMA×αCD3 XENP31602 alone or XENP31602 in combination with XENP34339; sequences for XENP31602 are depicted in FIG. 54) at the indicated concentrations. Cell kill was recorded for 5 days post T cell seeding. The data as depicted in FIG. 55 show that XENP31602 alone struggled to enhance cell kill in comparison to incubation of cancer and T cells alone indicating that there is a resistance to the CD3 bispecific at the low 1:1 effector to target ratio.

Notably, addition of B7H3 x CD28 overcomes cancer cell resistance to the CD3 bispecific. Although this experiment utilized a PSMA x CD3 bispecific antibody, it is reasonable to expect a similar outcome in combining the B7H3 x CD28 bispecific antibodies of the invention with other CD3 bispecific antibodies including those utilizing the CD3 binding domains depicted in FIG. 56.

5D: XENP34339 Combines with PSMA x CD3 Bispecifics to Enhance Activity Only in the Presence of Both B7H3 and PSMA 10,000 cancer cells (LNCaP [PSMA+B7H3+], 22RV1 [PSMA+B7H3+], SKOV-3 [PSMA-B7H3+], or OVCAR-8 [PSMA-B7H3+]) were first seeded. The following day, freshly enriched $CD3^+$ T cells were added at an effector: target ratio of 1:1 with 1 g/ml XENP34339 in combination with a dose titration of an illustrative CD3 bispecific (αPSMA×αCD3 XENP31602). One day post T cell seeding, cytokines were measure using MSD assay and $CD3^+$ T cells were counted using flow cytometry, data for which are depicted in FIGS. 57-60. The data show that the CD3 bispecific XENP31602 alone induced little to no T cell activity and proliferation at the low 1:1 effector:target ratio. However in the presence of LNCaP and 22Rvl which are PSMA+B7H3+, the addition of αB7H3 x αCD28 XENP34339 enhances the activity of αPSMA x αCD3 XENP31602. Notably, however, in the presence of SKOV-2 and OVCAR-8 which are PSMA-B7H3+, the addition of XENP343398 does not enhance activity. This requirement for both the tumor antigen associated with the CD28 bispecific antibody and the tumor antigen associated with the CD3 bispecific creates an AND gate useful for selectively targeting immune response to tumor cells which are more likely to co-express multiple tumor-associated antigens. This synergistic AND gate may also enable activity on tumors having lower target densities wherein the tumor cells may express multiple tumor-associated antigens albeit at low densities.

5E: Combining XENP34339 or XENP35612 with CD3 Bispecific Antibodies Increase Anti-Tumor Activity In Vivo In an in vivo study, NSG mice were engrafted intradermally with $2\times10^6$ pp-65 expressing MDA-MB-231 cells in the right flank on Day −23. On Day −1, mice were engrafted intraperitoneally with $5\times10^6$ human PBMCs. Mice were then treated on Days 0, 8, 14, 21, and 28 with a first illustrative B7H3 x CD3 bispecific antibody (CD3bsAb1) (0.5 mg/kg) alone, a second illustrative B7H3 x CD3 bispecific antibody (CD3bsAb2) (0.5 mg/kg) alone, or a combination of XENP34339 (5.0 mg/kg) with CD3bsAb1 or CD3bsAb2. Tumor volumes were monitored by caliper measurements, data for which are shown (days post $1^{st}$ dose) in FIGS. 61-62. Blood was drawn once per week to investigate lymphocyte expansion, data for which are depicted in FIG. 63 for CD45+ cells on Day 14. The data shows that adding CD28 costimulation to a CD3 bispecific increases anti-tumor activity in vivo. Notably, CD28 costimulation enables up to a 600-fold increase in lymphocyte expansion.

In another in vivo study, NSG mice that were MHC I/II-DKO (NSG-DKO) and thus resistant to GVHD and another CD3 bispecific (a PSMA x CD3 were used. On Day −7, NSG-DKO mice were inoculated with $5\times10^6$ 22RV1 tumor cells each. On Day 0, mice were engrafted with $5\times10^6$ human PBMC cells from a random donor. Mice were then intraperitoneally treated on Days 0, 7, 14, and 21 with low or high concentration doses of illustrative PSMA x CD3 bispecific antibody XENP32220 (sequences as depicted in FIG. 54) alone or in combination with XENP34339. Blood and serum were drawn weekly. Treatment with both the CD3 and the CD28 bsAbs enhanced T cell expansion (as indicated by lymphocyte counts in FIG. 64A-C and specifically T cells expressing Ki67 proliferation marker in FIG. 64D-E) as well as T cell activation (as indicated by CD25 and PD1 expression on $CD4^+$ and $CD8^+$ T cells in FIG. 65) in comparison to treatment with the CD3 bsAb alone.

In another study, CD34+ Hu-NSG, which are NSG mice engrafted with human CD34+ hematopoietic stem cells so as to develop a functional human immune system with no reactivity towards the host were obtained from The Jackson Laboratory (Bar Harbor, Maine), were used. On Day −15, mice were intradermally inoculated with $4\times10^6$ pp65-MDA-MB231 cells. Mice were then treated intraperitoneally on Days 0, 7, and 14 with B7H3 x CD3 bsAb alone, XENP35612 alone, B7H3 x CD3 bsAb in combination with XENP35612, or B7H3 x CD3 bsAb in combination with XENP34339. Tumor volumes were monitored by caliper measurements, data for which are shown (days post $1^{st}$ dose) in FIGS. 66-67. Tumor was harvested on Day 23 to investigate expansion of tumor infiltrating lymphocytes, data for which are depicted in FIG. 68. The data show that XENP35612 combines well with CD3 bsAb to suppress tumor growth. Notably, combination of B7H3 x CD28 with B7H3 x CD3 enables significantly enhanced anti-tumor activity in comparison to treatment with B7H3×CD3 alone at earlier time points (i.e. days 6 and 9). Additionally, XENP35612 as a single agent significantly expands expansion of tumor infiltrating lymphocytes; and combination of XENP35612 and B7H3 x CD3 bsAb significantly enhances expansion of tumor infiltrating lymphocytes in comparison to B7H3 x CD3 bsAb alone.

5F: XENP34339 and XENP37808 are not Superagonistic

Potential superagonistic properties of XENP34339 and XENP37808 were assessed by air-drying per the Stebbings protocol (Stebbings R. et al. 2007). Air-drying of test articles was achieved by drying in a SpeedVac™ for 2 hours at room temperature. Human PBMCs were treated for 24 hours with 10 μg of air-dried XENP34339 or XENP37808, and activity was compared to the superagonist TGN1412 (XENP29154; sequences for which are depicted in FIG. 69) or PBS control. Airdried TGN1412 promoted IFNγ, IL-6, IL-2, and TNF cytokine secretion from unstimulated human PBMC. In comparison, the cytokine levels in PBMCs treated with air-dried XENP34339 and XENP37808 remained similar to the negative control of PBS (data shown in FIGS. 70-71).

5G: XENP37808 Enhances CD3 Activity of Both Human & Cynomolgus PBMC

In order to investigate whether or not cynomolgus would be a good model for toxicology studies, an experiment was performed in which PBMCs from 11 unique human donors or 12 unique cynomolgus donors are dosed with XENP37808 in the presence of HEK cells transfected with anti-CD3 scFv (to provide "Signal 1") at a 10:1 E:T ratio. After 1 or 5 days, IL-2 release was measured using MSD assay. The results as depicted in FIG. 72 (data from one human donor and one cynomolgus donor) verify that cynomolgus is a comparably relevant species. Additionally, HEK cells transfected with anti-CD3 scFv but with B7H3 expression knocked out were also tested. Consistent with the data in Example 5D, these results show that XENP37808 enhances CD3 activity of human PBMCs exclusively in the presence of B7H3.

5H: Additional In Vitro Comparison of XENP34398 and XENP37808

In a first set of experiments, 1,250 22RV1-NLR (having a MESF value of ~170K B7H3 antigens) or DU145-NLR cancer cells (having ~270K B7H3 antigens) were seeded per well. After 48 hrs, $CD3^+$ T cells were added at an effector to target ratio of 1:1 with indicated amounts of B7H3 x CD3 and 1 μg/mL B7H3 x CD28, and cell counts were recorded by Incucyte. The results, shown in FIG. 73, demonstrate that in combination with a B7H3 x CD3 bispecific, both XENP34398 and XENP37808 induce very similar levels of RTCC.

In an additional set of experiment 10,000 target cancer cells (OVCAR8 having ~20K B7H3 surface density; 22RV1-NLR having ~170K B7H3 antigen density; or DU145-NLR having ~270K B7H3 antigen density) per well were seeded. The next day T-cells at an effector to target ratio of 1:1 were added with indicated amounts of B7H3 x CD28 mAb in the presence of 1 g/mL of an illustrative B7H3 x CD3 bsAb. IL-2 was assayed 24 hours after seeding. The results shown in FIG. 74 depict the very similar levels of function as measured by IL-2 induction of XENP34398 and XENP37808 on cell lines of various densities.

Together, these data show that both XENP37808 and XENP34398 display very similar activity and are equally efficacious. However, each may potentially have their own advantages in a clinical setting.

SEQUENCE LISTING (1200 sequences)

SEQ ID NO: 1 - protein, 121 aa, synthetic construct
  source 1..121: note = Description of Artificial Sequence: Synthetic polypeptide; note = CD28.3[CD28]_H0L0 Variable heavy (vh) domain
EVKLQQSGAELVKPGASVRLSCKASGYTFTEYIIHWIKLRSGQGLEWIGWFYPGSNDIQYNAKFKGKATLTADKSSSTVYMELTGLTSEDSAVYFCARRDDFSGYDALPYWGQGTMVTVSS

SEQ ID NO: 2 - protein, 5 aa, synthetic construct
  source 1..5: note = Description of Artificial Sequence: Synthetic peptide; note = CD28.3[CD28]_H0L0 vhCDR1
EYIIH

SEQ ID NO: 3 - protein, 17 aa, synthetic construct
  source 1..17: note = Description of Artificial Sequence: Synthetic peptide; note = CD28.3[CD28]_H0L0 vhCDR2
WFYPGSNDIQYNAKFKG

SEQ ID NO: 4 - protein, 12 aa, synthetic construct
  source 1..12: note = Description of Artificial Sequence: Synthetic peptide; note = CD28.3[CD28]_H0L0 vhCDR3
RDDFSGYDALPY

SEQ ID NO: 5 - protein, 107 aa, synthetic construct
  source 1..107: note = Description of Artificial Sequence: Synthetic polypeptide; note = CD28.3[CD28]_H0L0 Variable light (vl) domain
DIQMTQSPASLSVSVGETVTITCRTNENIYSNLAWYQQKQGKSPQLLIYAATHLVEGVPSRFSGSGSGTQYSLKITSLQSEDFGNYYCQHFWGTPCTFGGGTKLEIK

SEQ ID NO: 6 - protein, 11 aa, synthetic construct
  source 1..11: note = Description of Artificial Sequence: Synthetic peptide; note = CD28.3[CD28]_H0L0 vlCDR1
RTNENIYSNLA

SEQ ID NO: 7 - protein, 7 aa, synthetic construct
  source 1..7: note = Description of Artificial Sequence: Synthetic peptide; note = CD28.3[CD28]_H0L0 vlCDR2
AATHLVE

SEQ ID NO: 8 - protein, 9 aa, synthetic construct
  source 1..9: note = Description of Artificial Sequence: Synthetic peptide; note = CD28.3[CD28]_H0L0 vlCDR3
QHFWGTPCT

SEQ ID NO: 9 - protein, 121 aa, synthetic construct
  source 1..121: note = Description of Artificial Sequence: Synthetic polypeptide; note = hCD28.3[CD28]_H1L1 Variable heavy (vh) domain
QVQLQQSGAELKKPGASVKVSCKASGYTFTEYIIHWIKLRSGQGLEWIGWFYPGSNDIQYNAQFKGKATLTADKSSSTVYMELTGLTPEDSAVYFCARRDDFSGYDALPYWGQGTLVTVSA

SEQ ID NO: 10 - protein, 5 aa, synthetic construct
  source 1..5: note = Description of Artificial Sequence: Synthetic peptide; note = hCD28.3[CD28]_H1L1 vhCDR1
EYIIH

SEQ ID NO: 11 - protein, 17 aa, synthetic construct
  source 1..17: note = Description of Artificial Sequence: Synthetic peptide; note = hCD28.3[CD28]_H1L1 vhCDR2
WFYPGSNDIQYNAQFKG

SEQ ID NO: 12 - protein, 12 aa, synthetic construct
  source 1..12: note = Description of Artificial Sequence: Synthetic peptide; note = hCD28.3[CD28]_H1L1 vhCDR3
RDDFSGYDALPY

SEQ ID NO: 13 - protein, 107 aa, synthetic construct
  source 1..107: note = Description of Artificial Sequence: Synthetic polypeptide; note = hCD28.3[CD28]_H1L1 Variable light (vl) domain
DIQMTQSPSSLSASVGDRVTITCKTNENIYSNLAWYQQKDGKSPQLLIYAATHLVEGVPSRFSGSGSGTQYSLTISSLQPEDFGNYYCQHFWGTPCTFGGGTKLEIK

SEQ ID NO: 14 - protein, 11 aa, synthetic construct
  source 1..11: note = Description of Artificial Sequence: Synthetic peptide; note = hCD28.3[CD28]_H1L1 vlCDR1
KTNENIYSNLA

SEQ ID NO: 15 - protein, 7 aa, synthetic construct
  source 1..7: note = Description of Artificial Sequence: Synthetic peptide; note = hCD28.3[CD28]_H1L1 vlCDR2
AATHLVE

SEQ ID NO: 16 - protein, 9 aa, synthetic construct
  source 1..9: note = Description of Artificial Sequence: Synthetic peptide; note = hCD28.3[CD28]_H1L1 vlCDR3
QHFWGTPCT

SEQ ID NO: 17 - protein, 120 aa, synthetic construct
  source 1..120: note = Description of Artificial Sequence: Synthetic polypeptide; note = 5.11A1[CD28]_H0L0 Variable heavy (vh) domain
QVQLQQSGPELVKPGTSVRISCEASGYTFTSYYIHWVKQRPGQGLEWIGCIYPGNVNTNYNEKFKDKATLIVDTSSNTAYMQLSRMTSEDSAVYFCTRSHYGLDWNFDVWGAGTTVTVSS

SEQ ID NO: 18 - protein, 5 aa, synthetic construct
  source 1..5: note = Description of Artificial Sequence: Synthetic peptide; note = 5.11A1[CD28]_H0L0 vhCDR1
SYYIH

SEQ ID NO: 19 - protein, 17 aa, synthetic construct
  source 1..17: note = Description of Artificial Sequence: Synthetic peptide; note = 5.11A1[CD28]_H0L0 vhCDR2
CIYPGNVNTNYNEKFKD

SEQ ID NO: 20 - protein, 11 aa, synthetic construct
  source 1..11: note = Description of Artificial Sequence: Synthetic peptide; note = 5.11A1[CD28]_H0L0 vhCDR3
SHYGLDWNFDV

SEQ ID NO: 21 - protein, 107 aa, synthetic construct
  source 1..107: note = Description of Artificial Sequence: Synthetic polypeptide; note = 5.11A1[CD28]_H0L0 Variable light (vl) domain
DIQMNQSPSSLSASLGDTITITCHASQNIYVWLNWYQQKPGNIPKLLIYKASNLHTGVPSRFSGSGSGTGFTLTISSLQPEDIATYYCQQGQTYPYTFGGGTKLEIK

SEQ ID NO: 22 - protein, 11 aa, synthetic construct
  source 1..11: note = Description of Artificial Sequence: Synthetic peptide; note = 5.11A1[CD28]_H0L0 vlCDR1
HASQNIYVWLN

SEQ ID NO: 23 - protein, 7 aa, synthetic construct
  source 1..7: note = Description of Artificial Sequence: Synthetic peptide; note = 5.11A1[CD28]_H0L0 vlCDR2
KASNLHT

SEQ ID NO: 24 - protein, 9 aa, synthetic construct
  source 1..9: note = Description of Artificial Sequence: Synthetic peptide; note = 5.11A1[CD28]_H0L0 vlCDR3
QQGQTYPYT

SEQ ID NO: 25 - protein, 120 aa, synthetic construct
  source 1..120: note = Description of Artificial Sequence: Synthetic polypeptide; note = TGN1412_H1L1 Variable heavy (vh) domain
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSS

SEQ ID NO: 26 - protein, 5 aa, synthetic construct
  source 1..5: note = Description of Artificial Sequence: Synthetic peptide; note = TGN1412_H1L1 vhCDR1
SYYIH

SEQ ID NO: 27 - protein, 17 aa, synthetic construct
  source 1..17: note = Description of Artificial Sequence: Synthetic peptide; note = TGN1412_H1L1 vhCDR2
CIYPGNVNTNYNEKFKD

SEQ ID NO: 28 - protein, 11 aa, synthetic construct
  source 1..11: note = Description of Artificial Sequence: Synthetic peptide; note = TGN1412_H1L1 vhCDR3
SHYGLDWNFDV

SEQ ID NO: 29 - protein, 107 aa, synthetic construct
  source 1..107: note = Description of Artificial Sequence: Synthetic polypeptide; note = TGN1412_H1L1 Variable light (vl) domain
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIK

SEQ ID NO: 30 - protein, 11 aa, synthetic construct
  source 1..11: note = Description of Artificial Sequence: Synthetic peptide; note = TGN1412_H1L1 vlCDR1
HASQNIYVWLN

SEQ ID NO: 31 - protein, 7 aa, synthetic construct
  source 1..7: note = Description of Artificial Sequence: Synthetic peptide; note = TGN1412_H1L1 vlCDR2
KASNLHT

SEQ ID NO: 32 - protein, 9 aa, synthetic construct
  source 1..9: note = Description of Artificial Sequence: Synthetic peptide; note = TGN1412_H1L1 vlCDR3
QQGQTYPYT

SEQ ID NO: 33 - protein, 127 aa, synthetic construct
  source 1..127: note = Description of Artificial Sequence: Synthetic polypeptide; note = 341VL34[CD28]_H1L1 Variable heavy (vh) domain
EVQLVESGGGLVKPGGSLRLSCGGSGFTFNNAWMNWVRQAPGKGLEWVGRIKGKTDGGTADYAAPVKGRFTISRDYSKNTLYLQMNSLTTEDTAVYYCNTDLPYYYGSGRYSGMDVWGQGTTVTVSS

SEQ ID NO: 34 - protein, 5 aa, synthetic construct
  source 1..5: note = Description of Artificial Sequence: Synthetic peptide; note = 341VL34[CD28]_H1L1 vhCDR1
NAWMN

SEQ ID NO: 35 - protein, 19 aa, synthetic construct
  source 1..19: note = Description of Artificial Sequence: Synthetic peptide; note = 341VL34[CD28]_H1L1 vhCDR2
RIKGKTDGGTADYAAPVKG

SEQ ID NO: 36 - protein, 16 aa, synthetic construct
  source 1..16: note = Description of Artificial Sequence: Synthetic peptide; note = 341VL34[CD28]_H1L1 vhCDR3
DLPYYYGSGRYSGMDV

SEQ ID NO: 37 - protein, 104 aa, synthetic construct
  source 1..104: note = Description of Artificial Sequence: Synthetic polypeptide; note = 341VL34[CD28]_H1L1 Variable light (vl) domain
EIVLTQSPATLSLSPGERATLSCRASQSVSSYLAWYQQKPGQAPRLLIYDASNRATGIPARFSGSGSGTDFTLTISSLEPEDFAVYYCQQRSNTFGPGTKVDIK

SEQ ID NO: 38 - protein, 11 aa, synthetic construct
  source 1..11: note = Description of Artificial Sequence: Synthetic peptide; note = 341VL34[CD28]_H1L1 vlCDR1
RASQSVSSYLA

SEQ ID NO: 39 - protein, 7 aa, synthetic construct
  source 1..7: note = Description of Artificial Sequence: Synthetic peptide; note = 341VL34[CD28]_H1L1 vlCDR2
DASNRAT

SEQ ID NO: 40 - protein, 6 aa, synthetic construct
  source 1..6: note = Description of Artificial Sequence: Synthetic peptide; note = 341VL34[CD28]_H1L1 vlCDR3
QQRSNT

SEQ ID NO: 41 - protein, 127 aa, synthetic construct
  source 1..127: note = Description of Artificial Sequence: Synthetic polypeptide; note = 341VL36[CD28]_H1L1 Variable heavy (vh) domain
EVQLVESGGGLVKPGGSLRLSCGGSGFTFNNAWMNWVRQAPGKGLEWVGRIKGKTDGGTADYAAPVKGRFTISRDYSKNTLYLQMNSLKTEDTGVYYCTTYLPYYYGSERWSGMDVWGQGTTVTVSS

SEQ ID NO: 42 - protein, 5 aa, synthetic construct
  source 1..5: note = Description of Artificial Sequence: Synthetic peptide; note = 341VL36[CD28]_H1L1 vhCDR1
NAWMN

SEQ ID NO: 43 - protein, 19 aa, synthetic construct
  source 1..19: note = Description of Artificial Sequence: Synthetic peptide; note = 341VL36[CD28]_H1L1 vhCDR2
RIKGKTDGGTADYAAPVKG

SEQ ID NO: 44 - protein, 16 aa, synthetic construct
  source 1..16: note = Description of Artificial Sequence: Synthetic peptide; note = 341VL36[CD28]_H1L1 vhCDR3
YLPYYYGSERWSGMDV

SEQ ID NO: 45 - protein, 104 aa, synthetic construct; identical to SEQ ID NO: 37
  source 1..104: note = Description of Artificial Sequence: Synthetic polypeptide; note = 341VL36[CD28]_H1L1 Variable light (vl) domain

SEQ ID NO: 46 - protein, 11 aa, synthetic construct
  source 1..11: note = Description of Artificial Sequence: Synthetic peptide; note = 341VL36[CD28]_H1L1 vlCDR1
RASQSVSSYLA

SEQ ID NO: 47 - protein, 7 aa, synthetic construct
  source 1..7: note = Description of Artificial Sequence: Synthetic peptide; note = 341VL36[CD28]_H1L1 vlCDR2
DASNRAT

SEQ ID NO: 48 - protein, 6 aa, synthetic construct
  source 1..6: note = Description of Artificial Sequence: Synthetic peptide; note = 341VL36[CD28]_H1L1 vlCDR3
QQRSNT

SEQ ID NO: 49 - protein, 126 aa, synthetic construct
  source 1..126: note = Description of Artificial Sequence: Synthetic polypeptide; note = 281VL4[CD28]_H1L1 Variable heavy (vh) domain
EVQLVQSGSELKKPGSSVKVSCKASGGTSRSFAISWVRQAPGQGLEWMGGIIPIFGPANYAQKFQGRVTITADESTSTAYMELSSLRSEDTAVYYCARHAIAMGWGVITTNYFDSWGQGTMVTVSS

SEQ ID NO: 50 - protein, 5 aa, synthetic construct
  source 1..5: note = Description of Artificial Sequence: Synthetic peptide; note = 281VL4[CD28]_H1L1 vhCDR1
SFAIS

SEQ ID NO: 51 - protein, 17 aa, synthetic construct
  source 1..17: note = Description of Artificial Sequence: Synthetic peptide; note = 281VL4[CD28]_H1L1 vhCDR2
GIIPIFGPANYAQKFQG

SEQ ID NO: 52 - protein, 17 aa, synthetic construct
  source 1..17: note = Description of Artificial Sequence: Synthetic peptide; note = 281VL4[CD28]_H1L1 vhCDR3
HAIAMGWGVITTNYFDS

SEQ ID NO: 53 - protein, 108 aa, synthetic construct
  source 1..108: note = Description of Artificial Sequence: Synthetic polypeptide; note = 281VL4[CD28]_H1L1 Variable light (vl) domain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIK

SEQ ID NO: 54 - protein, 12 aa, synthetic construct
  source 1..12: note = Description of Artificial Sequence: Synthetic peptide; note = 281VL4[CD28]_H1L1 vlCDR1
RASQSVSSSYLA

SEQ ID NO: 55 - protein, 7 aa, synthetic construct
  source 1..7: note = Description of Artificial Sequence: Synthetic peptide; note = 281VL4[CD28]_H1L1 vlCDR2
GASSRAT

SEQ ID NO: 56 - protein, 9 aa, synthetic construct
  source 1..9: note = Description of Artificial Sequence: Synthetic peptide; note = 281VL4[CD28]_H1L1 vlCDR3
QQYGSSPIT

SEQ ID NO: 57 - protein, 121 aa, synthetic construct
  source 1..121: note = Description of Artificial Sequence: Synthetic polypeptide; note = HuTN228[CD28]_H1L1 Variable heavy (vh) domain
QVQLQESGPGLVKPSETLSLTCAVSGFSLTSYGVHWIRQPPGKGLEWLGVIWPGGGTNFNSALMSRLTISEDTSKNQVSLKLSSVTAADTAVYYCARDRAYGNYLYAMDYWGQGTLVTVSS

SEQ ID NO: 58 - protein, 5 aa, synthetic construct
  source 1..5: note = Description of Artificial Sequence: Synthetic peptide; note = HuTN228[CD28]_H1L1 vhCDR1
SYGVH

SEQ ID NO: 59 - protein, 16 aa, synthetic construct
  source 1..16: note = Description of Artificial Sequence: Synthetic peptide; note = HuTN228[CD28]_H1L1 vhCDR2
VIWPGGGTNFNSALMS

SEQ ID NO: 60 - protein, 13 aa, synthetic construct
  source 1..13: note = Description of Artificial Sequence: Synthetic peptide; note = HuTN228[CD28]_H1L1 vhCDR3
DRAYGNYLYAMDY

SEQ ID NO: 61 - protein, 111 aa, synthetic construct
  source 1..111: note = Description of Artificial Sequence: Synthetic polypeptide; note = HuTN228[CD28]_H1L1 Variable light (vl) domain
DIQMTQSPSSLSASVGDRVTITCRASESVEYYVTSLMQWYQQKPGKAPKLLIYAASNVDSGVPSRFSGSGSGTDFTLTISSLQPEDIATYYCQQSRKVPFTFGGGTKVEIK

SEQ ID NO: 62 - protein, 15 aa, synthetic construct
  source 1..15: note = Description of Artificial Sequence: Synthetic peptide; note = HuTN228[CD28]_H1L1 vlCDR1
RASESVEYYVTSLMQ

SEQ ID NO: 63 - protein, 7 aa, synthetic construct
  source 1..7: note = Description of Artificial Sequence: Synthetic peptide; note = HuTN228[CD28]_H1L1 vlCDR2
AASNVDS

SEQ ID NO: 64 - protein, 9 aa, synthetic construct
  source 1..9: note = Description of Artificial Sequence: Synthetic peptide; note = HuTN228[CD28]_H1L1 vlCDR3
QQSRKVPFT

SEQ ID NO: 65 - protein, 124 aa, synthetic construct
  source 1..124: note = Description of Artificial Sequence: Synthetic polypeptide; note = PV1[CD28]_H0L0 Variable heavy (vh) domain
QVQLKQSGAELVKPGASVKISCKTSGYTFTDGYMNWVEQKPGQGLEWIGRIDPDSGNTRYNQKFQGKATLTRDKSSSTVYMDLRSLTSEDSAVYYCARDGTFYGTYGYWYFDFWGQGTQVTVSS

SEQ ID NO: 66 - protein, 5 aa, synthetic construct
  source 1..5: note = Description of Artificial Sequence: Synthetic peptide; note = PV1[CD28]_H0L0 vhCDR1
DGYMN

SEQ ID NO: 67 - protein, 17 aa, synthetic construct
  source 1..17: note = Description of Artificial Sequence: Synthetic peptide; note = PV1[CD28]_H0L0 vhCDR2
RIDPDSGNTRYNQKFQG

SEQ ID NO: 68 - protein, 15 aa, synthetic construct
  source 1..15: note = Description of Artificial Sequence: Synthetic peptide; note = PV1[CD28]_H0L0 vhCDR3
DGTFYGTYGYWYFDF

SEQ ID NO: 69 - protein, 113 aa, synthetic construct
  source 1..113: note = Description of Artificial Sequence: Synthetic polypeptide; note = PV1[CD28]_H0L0 Variable light (vl) domain
DIVMTQSPYSLAVSAGEKVTMSCRSSQSLYYSGIKKNLLAWYQQKPGQSPKLLIYFTSTRLPGVPDRFTGSGSGTDYTLTITSVQAEDMGHYFCQQGISTPLTFGDGTKLEIR

SEQ ID NO: 70 - protein, 17 aa, synthetic construct
  source 1..17: note = Description of Artificial Sequence: Synthetic peptide; note = PV1[CD28]_H0L0 vlCDR1
RSSQSLYYSGIKKNLLA

SEQ ID NO: 71 - protein, 7 aa, synthetic construct
  source 1..7: note = Description of Artificial Sequence: Synthetic peptide; note = PV1[CD28]_H0L0 vlCDR2
FTSTRLP

SEQ ID NO: 72 - protein, 9 aa, synthetic construct
  source 1..9: note = Description of Artificial Sequence: Synthetic peptide; note = PV1[CD28]_H0L0 vlCDR3
QQGISTPLT

SEQ ID NO: 73 - protein, 120 aa, synthetic construct
  source 1..120: note = Description of Artificial Sequence: Synthetic polypeptide; note = m9.3[CD28]_H0L0 Variable heavy (vh) domain
EVKLQQSGPGLVTPSQSLSITCTVSGFSLSDYGVHWVRQSPGQGLEWLGVIWAGGGTNYNSALMSRKSISKDNSKSQVFLKMNSLQADDTAVYYCARDKGYSYYYSMDYWGQGTSVTVSS

SEQ ID NO: 74 - protein, 5 aa, synthetic construct
  source 1..5: note = Description of Artificial Sequence: Synthetic peptide; note = m9.3[CD28]_H0L0 vhCDR1
DYGVH

SEQ ID NO: 75 - protein, 16 aa, synthetic construct
  source 1..16: note = Description of Artificial Sequence: Synthetic peptide; note = m9.3[CD28]_H0L0 vhCDR2
VIWAGGGTNYNSALMS

SEQ ID NO: 76 - protein, 12 aa, synthetic construct
  source 1..12: note = Description of Artificial Sequence: Synthetic peptide; note = m9.3[CD28]_H0L0 vhCDR3
DKGYSYYYSMDY

SEQ ID NO: 77 - protein, 111 aa, synthetic construct
  source 1..111: note = Description of Artificial Sequence: Synthetic polypeptide; note = m9.3[CD28]_H0L0 Variable light (vl) domain
DIELTQSPASLAVSLGQRATISCRASESVEYYVTSLMQWYQQKPGQPPKLLIFAASNVESGVPARFSGSGSGTNFSLNIHPVDEDDVAMYFCQQSRKVPYTFGGGTKLEIK

SEQ ID NO: 78 - protein, 15 aa, synthetic construct
  source 1..15: note = Description of Artificial Sequence: Synthetic peptide; note = m9.3[CD28]_H0L0 vlCDR1
RASESVEYYVTSLMQ

SEQ ID NO: 79 - protein, 7 aa, synthetic construct
  source 1..7: note = Description of Artificial Sequence: Synthetic peptide; note = m9.3[CD28]_H0L0 vlCDR2
AASNVES

SEQ ID NO: 80 - protein, 9 aa, synthetic construct
  source 1..9: note = Description of Artificial Sequence: Synthetic peptide; note = m9.3[CD28]_H0L0 vlCDR3
QQSRKVPYT

SEQ ID NO: 81 - protein, 120 aa, synthetic construct
  source 1..120: note = Description of Artificial Sequence: Synthetic polypeptide; note = hu9.3[CD28]_H1L1 Variable heavy (vh) domain
EVQLVQSGGGLVQPGGSLRLSCAGSGFTFSDYGVHWVRQAPGKGLEWVSAIWAGGGTNYASSVMGRFTISRDNAKNSLYLQMNSLRAEDMAVYYCARDKGYSYYYSMDYWGQGTLVTVSS

SEQ ID NO: 82 - protein, 5 aa, synthetic construct
  source 1..5: note = Description of Artificial Sequence: Synthetic peptide; note = hu9.3[CD28]_H1L1 vhCDR1
DYGVH

SEQ ID NO: 83 - protein, 16 aa, synthetic construct
  source 1..16: note = Description of Artificial Sequence: Synthetic peptide; note = hu9.3[CD28]_H1L1 vhCDR2
AIWAGGGTNYASSVMG

SEQ ID NO: 84 - protein, 12 aa, synthetic construct
  source 1..12: note = Description of Artificial Sequence: Synthetic peptide; note = hu9.3[CD28]_H1L1 vhCDR3
DKGYSYYYSMDY

SEQ ID NO: 85 - protein, 111 aa, synthetic construct
  source 1..111: note = Description of Artificial Sequence: Synthetic polypeptide; note = hu9.3[CD28]_H1L1 Variable light (vl) domain
DIVMTQSPDSLAVSLGERATINCRASESVEYYVTSLMAWYQQKPGQPPKLLIYAASNVESGVPDRFSGSGSGTNFSLTISSLQAEDVAVYYCQQSRKVPYTFGQGTKLEIK

SEQ ID NO: 86 - protein, 15 aa, synthetic construct
  source 1..15: note = Description of Artificial Sequence: Synthetic peptide; note = hu9.3[CD28]_H1L1 vlCDR1
RASESVEYYVTSLMA

SEQ ID NO: 87 - protein, 7 aa, synthetic construct
  source 1..7: note = Description of Artificial Sequence: Synthetic peptide; note = hu9.3[CD28]_H1L1 vlCDR2
AASNVES

SEQ ID NO: 88 - protein, 9 aa, synthetic construct
  source 1..9: note = Description of Artificial Sequence: Synthetic peptide; note = hu9.3[CD28]_H1L1 vlCDR3
QQSRKVPYT

SEQ ID NO: 89 - protein, 120 aa, synthetic construct
  source 1..120: note = Description of Artificial Sequence: Synthetic polypeptide; note = omburtamab Variable heavy (vh) domain
VHQVQLQQSGAELVKPGASVKLSCKASGYTFTNYDINWVRQRPEQGLEWIGWIFPGDGSTQYNEKFKGKATLTTDTSSSTAYMQLSRLTSEDSAVYFCARQTTATWFAYWGQGTLVTVSA

SEQ ID NO: 90 - protein, 5 aa, synthetic construct
  source 1..5: note = Description of Artificial Sequence: Synthetic peptide; note = omburtamab vhCDR1
NYDIN

SEQ ID NO: 91 - protein, 17 aa, synthetic construct
  source 1..17: note = Description of Artificial Sequence: Synthetic peptide; note = omburtamab vhCDR2
WIFPGDGSTQYNEKFKG

SEQ ID NO: 92 - protein, 9 aa, synthetic construct
  source 1..9: note = Description of Artificial Sequence: Synthetic peptide; note = omburtamab vhCDR3
QTTATWFAY

SEQ ID NO: 93 - protein, 109 aa, synthetic construct
  source 1..109: note = Description of Artificial Sequence: Synthetic polypeptide; note = omburtamab Variable light (vl) domain
VLDIVMTQSPATLSVTPGDRVSLSCRASQSISDYLHWYQQKSHESPRLLIKYASQSISGIPSRFSGSGSGSDFTLSINSVEPEDVGVYYCQNGHSFPLTFGAGTKLELK

SEQ ID NO: 94 - protein, 11 aa, synthetic construct
  source 1..11: note = Description of Artificial Sequence: Synthetic peptide; note = omburtamab vlCDR1
RASQSISDYLH

SEQ ID NO: 95 - protein, 7 aa, synthetic construct
  source 1..7: note = Description of Artificial Sequence: Synthetic peptide; note = omburtamab vlCDR2
YASQSIS

SEQ ID NO: 96 - protein, 9 aa, synthetic construct
  source 1..9: note = Description of Artificial Sequence: Synthetic peptide; note = omburtamab vlCDR3
QNGHSFPLT

SEQ ID NO: 97 - protein, 124 aa, synthetic construct
  source 1..124: note = Description of Artificial Sequence: Synthetic polypeptide; note = enoblituzumab Variable heavy (vh) domain
VHEVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSS

SEQ ID NO: 98 - protein, 5 aa, synthetic construct
  source 1..5: note = Description of Artificial Sequence: Synthetic peptide; note = enoblituzumab vhCDR1
SFGMH

SEQ ID NO: 99 - protein, 17 aa, synthetic construct
  source 1..17: note = Description of Artificial Sequence: Synthetic peptide; note = enoblituzumab vhCDR2
YISSDSSAIYYADTVKG

SEQ ID NO: 100 - protein, 13 aa, synthetic construct
  source 1..13: note = Description of Artificial Sequence: Synthetic peptide; note = enoblituzumab vhCDR3
GRENIYYGSRLDY

SEQ ID NO: 101 - protein, 109 aa, synthetic construct
  source 1..109: note = Description of Artificial Sequence: Synthetic polypeptide; note = enoblituzumab Variable light (vl) domain
VLDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 102 - protein, 11 aa, synthetic construct
  source 1..11: note = Description of Artificial Sequence: Synthetic peptide; note = enoblituzumab vlCDR1
KASQNVDTNVA

SEQ ID NO: 103 - protein, 7 aa, synthetic construct
  source 1..7: note = Description of Artificial Sequence: Synthetic peptide; note = enoblituzumab vlCDR2
SASYRYS

SEQ ID NO: 104 - protein, 9 aa, synthetic construct
  source 1..9: note = Description of Artificial Sequence: Synthetic peptide; note = enoblituzumab vlCDR3
QQYNNYPFT

SEQ ID NO: 105 - protein, 124 aa, synthetic construct
  source 1..124: note = Description of Artificial Sequence: Synthetic polypeptide; note = BRCA84D Variable heavy (vh) domain
VHDVQLVESGGGLVQPGGSRKLSCAASGFTFSSFGMHWVRQAPEKGLEWVAYISSDSSAIYYADTVKGRFTISRDNPKNTLFLQMTSLRSEDTAMYYCGRGRENIYYGSRLDYWGQGTTLTVSS

SEQ ID NO: 106 - protein, 5 aa, synthetic construct
  source 1..5: note = Description of Artificial Sequence: Synthetic peptide; note = BRCA84D vhCDR1
SFGMH

SEQ ID NO: 107 - protein, 17 aa, synthetic construct
  source 1..17: note = Description of Artificial Sequence: Synthetic peptide; note = BRCA84D vhCDR2
YISSDSSAIYYADTVKG

SEQ ID NO: 108 - protein, 13 aa, synthetic construct
  source 1..13: note = Description of Artificial Sequence: Synthetic peptide; note = BRCA84D vhCDR3
GRENIYYGSRLDY

SEQ ID NO: 109 - protein, 109 aa, synthetic construct
  source 1..109: note = Description of Artificial Sequence: Synthetic polypeptide; note = BRCA84D Variable light (vl) domain
VLDIAMTQSQKFMSTSVGDRVSVTCKASQNVDTNVAWYQQKPGQSPKALIYSASYRYSGVPDRFTGSGSGTDFTLTINNVQSEDLAEYFCQQYNNYPFTFGSGTKLEIK

SEQ ID NO: 110 - protein, 11 aa, synthetic construct
  source 1..11: note = Description of Artificial Sequence: Synthetic peptide; note = BRCA84D vlCDR1
KASQNVDTNVA

SEQ ID NO: 111 - protein, 7 aa, synthetic construct
  source 1..7: note = Description of Artificial Sequence: Synthetic peptide; note = BRCA84D vlCDR2
SASYRYS

SEQ ID NO: 112 - protein, 9 aa, synthetic construct
  source 1..9: note = Description of Artificial Sequence: Synthetic peptide; note = BRCA84D vlCDR3
QQYNNYPFT

SEQ ID NO: 113 - protein, 122 aa, synthetic construct
  source 1..122: note = Description of Artificial Sequence: Synthetic polypeptide; note = BRCA69D Variable heavy (vh) domain
VHQVQLQQSGAELARPGASVKLSCKASGYTFTSYWMQWVKQRPGQGLEWIGTIYPGDGDTRYTQKFKGKATLTADKSSSTAYMQLSSLASEDSAVYYCARRGIPRLWYFDVWGAGTTVTVSS

SEQ ID NO: 114 - protein, 5 aa, synthetic construct
  source 1..5: note = Description of Artificial Sequence: Synthetic peptide; note = BRCA69D vhCDR1
SYWMQ

SEQ ID NO: 115 - protein, 17 aa, synthetic construct
  source 1..17: note = Description of Artificial Sequence: Synthetic peptide; note = BRCA69D vhCDR2
TIYPGDGDTRYTQKFKG

SEQ ID NO: 116 - protein, 11 aa, synthetic construct
  source 1..11: note = Description of Artificial Sequence: Synthetic peptide; note = BRCA69D vhCDR3
RGIPRLWYFDV

SEQ ID NO: 117 - protein, 109 aa, synthetic construct
  source 1..109: note = Description of Artificial Sequence: Synthetic polypeptide; note = BRCA69D Variable light (vl) domain
VLDIQMTQTTSSLSASLGDRVTISCRASQDISNYLNWYQQKPDGTVKLLIYYTSRLHSGVPSRFSGSGSGTDYSLTIDNLEQEDIATYFCQQGNTLPPTFGGGTKLEIK

SEQ ID NO: 118 - protein, 11 aa, synthetic construct
  source 1..11: note = Description of Artificial Sequence: Synthetic peptide; note = BRCA69D vlCDR1
RASQDISNYLN

SEQ ID NO: 119 - protein, 7 aa, synthetic construct
  source 1..7: note = Description of Artificial Sequence: Synthetic peptide; note = BRCA69D vlCDR2
YTSRLHS

SEQ ID NO: 120 - protein, 9 aa, synthetic construct
  source 1..9: note = Description of Artificial Sequence: Synthetic peptide; note = BRCA69D vlCDR3
QQGNTLPPT

SEQ ID NO: 121 - protein, 119 aa, synthetic construct
  source 1..119: note = Description of Artificial Sequence: Synthetic polypeptide; note = PRCA157 Variable heavy (vh) domain
VHEVQQVESGGDLVKPGGSLKLSCAASGFTFSSYGMSWVRQTPDKRLEWVATINSGGSNTYYPDSLKGRFTISRDNAKNTLYLQMRSLKSEDTAMYYCARHDGGAMDYWGQGTSVTVSS

SEQ ID NO: 122 - protein, 5 aa, synthetic construct
  source 1..5: note = Description of Artificial Sequence: Synthetic peptide; note = PRCA157 vhCDR1
SYGMS

SEQ ID NO: 123 - protein, 17 aa, synthetic construct
  source 1..17: note = Description of Artificial Sequence: Synthetic peptide; note = PRCA157 vhCDR2
TINSGGSNTYYPDSLKG

SEQ ID NO: 124 - protein, 8 aa, synthetic construct
  source 1..8: note = Description of Artificial Sequence: Synthetic peptide; note = PRCA157 vhCDR3
HDGGAMDY

SEQ ID NO: 125 - protein, 110 aa, synthetic construct
  source 1..110: note = Description of Artificial Sequence: Synthetic polypeptide; note = PRCA157 Variable light (vl) domain
VLDIQMTQSPASLSVSVGETVTITCRASESIYSYLAWYQQKQGKSPQLLVYNTKTLPEGVPSRFSGSGSGTQFSLKINSLQPEDFGRYYCQHHYGTPPWTFGGGTNLEIK

SEQ ID NO: 126 - protein, 11 aa, synthetic construct
  source 1..11: note = Description of Artificial Sequence: Synthetic peptide; note = PRCA157 vlCDR1
RASESIYSYLA

SEQ ID NO: 127 - protein, 7 aa, synthetic construct
  source 1..7: note = Description of Artificial Sequence: Synthetic peptide; note = PRCA157 vlCDR2
NTKTLPE

SEQ ID NO: 128 - protein, 10 aa, synthetic construct
  source 1..10: note = Description of Artificial Sequence: Synthetic peptide; note = PRCA157 vlCDR3
QHHYGTPPWT

SEQ ID NO: 129 - protein, 119 aa, synthetic construct
  source 1..119: note = Description of Artificial Sequence: Synthetic polypeptide; note = huPRCA157 Variable heavy (vh) domain
VHEVQLVESGGGLVKPGGSLRLSCAASGFTFSSYGMSWVRQAPGKGLEWVATINSGGSNTYYPDSLKGRFTISRDNAKNSLYLQMNSLRAEDTAVYYCARHDGGAMDYWGQGTTVTVSS

SEQ ID NO: 130 - protein, 5 aa, synthetic construct
  source 1..5: note = Description of Artificial Sequence: Synthetic peptide; note = huPRCA157 vhCDR1
SYGMS

SEQ ID NO: 131 - protein, 17 aa, synthetic construct
  source 1..17: note = Description of Artificial Sequence: Synthetic peptide; note = huPRCA157 vhCDR2
TINSGGSNTYYPDSLKG

SEQ ID NO: 132 - protein, 8 aa, synthetic construct
  source 1..8: note = Description of Artificial Sequence: Synthetic peptide; note = huPRCA157 vhCDR3
HDGGAMDY

SEQ ID NO: 133 - protein, 110 aa, synthetic construct
  source 1..110: note = Description of Artificial Sequence: Synthetic polypeptide; note = huPRCA157 Variable light (vl) domain
VLDIQMTQSPSSLSASVGDRVTITCRASESIYSYLAWYQQKPGKAPKLLVYNTKTLPEGVPSRFSGSGSGTDFTLTISSLQPEDFATYYCQHHYGTPPWTFGQGTRLEIK

SEQ ID NO: 134 - protein, 11 aa, synthetic construct
  source 1..11: note = Description of Artificial Sequence: Synthetic peptide; note = huPRCA157 vlCDR1
RASESIYSYLA

SEQ ID NO: 135 - protein, 7 aa, synthetic construct
  source 1..7: note = Description of Artificial Sequence: Synthetic peptide; note = huPRCA157 vlCDR2
NTKTLPE

SEQ ID NO: 136 - protein, 10 aa, synthetic construct
  source 1..10: note = Description of Artificial Sequence: Synthetic peptide; note = huPRCA157 vlCDR3
QHHYGTPPWT

SEQ ID NO: 137 - protein, 121 aa, synthetic construct
  source 1..121: note = Description of Artificial Sequence: Synthetic polypeptide; note = mAb-D Variable heavy (vh) domain
VHDVQLAESGGGLVQPGGSRKLSCAASGFTFSSFGMHWVRQAPEKGLEWVAYISSGSGTIYYADTVKGRFTISRDNPKNSLFLQMTSLRSEDTAMYYCARHGYRYEGFDYWGQGTTLTVSS

SEQ ID NO: 138 - protein, 5 aa, synthetic construct
  source 1..5: note = Description of Artificial Sequence: Synthetic peptide; note = mAb-D vhCDR1
SFGMH

SEQ ID NO: 139 - protein, 17 aa, synthetic construct
  source 1..17: note = Description of Artificial Sequence: Synthetic peptide; note = mAb-D vhCDR2
YISSGSGTIYYADTVKG

SEQ ID NO: 140 - protein, 10 aa, synthetic construct
  source 1..10: note = Description of Artificial Sequence: Synthetic peptide; note = mAb-D vhCDR3
HGYRYEGFDY

SEQ ID NO: 141 - protein, 109 aa, synthetic construct
  source 1..109: note = Description of Artificial Sequence: Synthetic polypeptide; note = mAb-D Variable light (vl) domain
VLDIVMTQSQKFMSTSVGDRVSVTCKASQNVDTNVAWYQQKQGHSPEALIYSASYRYSGVPARFTGSGSGTDFTLTISNVQSEDLAEYFCQQYNNYPFTFGGGTKLEIK

SEQ ID NO: 142 - protein, 11 aa, synthetic construct
  source 1..11: note = Description of Artificial Sequence: Synthetic peptide; note = mAb-D vlCDR1
KASQNVDTNVA

SEQ ID NO: 143 - protein, 7 aa, synthetic construct
  source 1..7: note = Description of Artificial Sequence: Synthetic peptide; note = mAb-D vlCDR2
SASYRYS

SEQ ID NO: 144 - protein, 9 aa, synthetic construct
  source 1..9: note = Description of Artificial Sequence: Synthetic peptide; note = mAb-D vlCDR3
QQYNNYPFT

SEQ ID NO: 145 - protein, 121 aa, synthetic construct
  source 1..121: note = Description of Artificial Sequence: Synthetic polypeptide; note = humAb-D Variable heavy (vh) domain
VHEVQLVESGGGLVQPGGSLRLSCAASGFTFSSFGMHWVRQAPGKGLEWVAYISSGSGTIYYADTVKGRFTISRDNAKNSLYLQMNSLRAEDTAVYYCARHGYRYEGFDYWGQGTTVTVSS

SEQ ID NO: 146 - protein, 5 aa, synthetic construct
  source 1..5: note = Description of Artificial Sequence: Synthetic peptide; note = humAb-D vhCDR1
SFGMH

SEQ ID NO: 147 - protein, 17 aa, synthetic construct
  source 1..17: note = Description of Artificial Sequence: Synthetic peptide; note = humAb-D vhCDR2
YISSGSGTIYYADTVKG

SEQ ID NO: 148 - protein, 10 aa, synthetic construct
  source 1..10: note = Description of Artificial Sequence: Synthetic peptide; note = humAb-D vhCDR3
HGYRYEGFDY

SEQ ID NO: 149 - protein, 109 aa, synthetic construct
  source 1..109: note = Description of Artificial Sequence: Synthetic polypeptide; note = humAb-D Variable light (vl) domain
VLDIQMTQSPSFLSASVGDRVTITCKASQNVDTNVAWYQQKPGKAPKALIYSASYRYSGVPSRFSGSGSGTDFTLTISSLQPEDFAEYFCQQYNNYPFTFGQGTKLEIK

SEQ ID NO: 150 - protein, 11 aa, synthetic construct
  source 1..11: note = Description of Artificial Sequence: Synthetic peptide; note = humAb-D vlCDR1
KASQNVDTNVA

SEQ ID NO: 151 - protein, 7 aa, synthetic construct
  source 1..7: note = Description of Artificial Sequence: Synthetic peptide; note = humAb-D vlCDR2
SASYRYS

SEQ ID NO: 152 - protein, 9 aa, synthetic construct
  source 1..9: note = Description of Artificial Sequence: Synthetic peptide; note = humAb-D vlCDR3
QQYNNYPFT

SEQ ID NO: 153 - protein, 124 aa, synthetic construct
  source 1..124: note = Description of Artificial Sequence: Synthetic polypeptide; note = M30 Variable heavy (vh) domain
VHEVQLQQSGPELVKPGASVKMSCKASGYTFTNYVMHWVKQKPGQGLEWIGYINPYNDDVKYNEKFKGKATQTSDKSSSTAYMELSSLTSEDSAVYYCARWGYYGSPLYYFDYWGQGTTLTVSS

SEQ ID NO: 154 - protein, 5 aa, synthetic construct
  source 1..5: note = Description of Artificial Sequence: Synthetic peptide; note = M30 vhCDR1
NYVMH

SEQ ID NO: 155 - protein, 17 aa, synthetic construct
  source 1..17: note = Description of Artificial Sequence: Synthetic peptide; note = M30 vhCDR2
YINPYNDDVKYNEKFKG

SEQ ID NO: 156 - protein, 13 aa, synthetic construct
  source 1..13: note = Description of Artificial Sequence: Synthetic peptide; note = M30 vhCDR3
WGYYGSPLYYFDY

SEQ ID NO: 157 - protein, 108 aa, synthetic construct
  source 1..108: note = Description of Artificial Sequence: Synthetic polypeptide; note = M30 Variable light (vl) domain
VLQIVLSQSPTILSASPGEKVTMTCRASSRLIYMHWYQQKPGSSPKPWIYATSNLASGVPARFSGSGSGTSYSLTISRVEAEDAATYYCQQWNSNPPTFGTGTKLELK

SEQ ID NO: 158 - protein, 10 aa, synthetic construct
  source 1..10: note = Description of Artificial Sequence: Synthetic peptide; note = M30 vlCDR1
RASSRLIYMH

SEQ ID NO: 159 - protein, 7 aa, synthetic construct
  source 1..7: note = Description of Artificial Sequence: Synthetic peptide; note = M30 vlCDR2
ATSNLAS

SEQ ID NO: 160 - protein, 9 aa, synthetic construct
  source 1..9: note = Description of Artificial Sequence: Synthetic peptide; note = M30 vlCDR3
QQWNSNPPT

SEQ ID NO: 161 - protein, 124 aa, synthetic construct
  source 1..124: note = Description of Artificial Sequence: Synthetic polypeptide; note = M30-H1-L4 Variable heavy (vh) domain
VHQVQLVQSGAEVKKPGSSVKVSCKASGYTFTNYVMHWVRQAPGQGLEWMGYINPYNDDVKYNEKFKGRVTITADESTSTAYMELSSLRSEDTAVYYCARWGYYGSPLYYFDYWGQGTLVTVSS

SEQ ID NO: 162 - protein, 5 aa, synthetic construct
  source 1..5: note = Description of Artificial Sequence: Synthetic peptide; note = M30-H1-L4 vhCDR1
NYVMH

SEQ ID NO: 163 - protein, 17 aa, synthetic construct
  source 1..17: note = Description of Artificial Sequence: Synthetic peptide; note = M30-H1-L4 vhCDR2
YINPYNDDVKYNEKFKG

SEQ ID NO: 164 - protein, 13 aa, synthetic construct
  source 1..13: note = Description of Artificial Sequence: Synthetic peptide; note = M30-H1-L4 vhCDR3
WGYYGSPLYYFDY

SEQ ID NO: 165 - protein, 108 aa, synthetic construct
  source 1..108: note = Description of Artificial Sequence: Synthetic polypeptide; note = M30-H1-L4 Variable light (vl) domain
VLQIVLSQSPATLSLSPGERATLTCRASSRLIYMHWYQQKPGSAPKLWIYATSNLASGIPARFSGSGSGTSYTLTISRLEPEDFAVYYCQQWNSNPPTFGQGTKVEIK

SEQ ID NO: 166 - protein, 10 aa, synthetic construct
  source 1..10: note = Description of Artificial Sequence: Synthetic peptide; note = M30-H1-L4 vlCDR1
RASSRLIYMH

SEQ ID NO: 167 - protein, 7 aa, synthetic construct
  source 1..7: note = Description of Artificial Sequence: Synthetic peptide; note = M30-H1-L4 vlCDR2
ATSNLAS

SEQ ID NO: 168 - protein, 9 aa, synthetic construct
  source 1..9: note = Description of Artificial Sequence: Synthetic peptide; note = M30-H1-L4 vlCDR3
QQWNSNPPT

SEQ ID NO: 169 - protein, 122 aa, synthetic construct
  source 1..122: note = Description of Artificial Sequence: Synthetic polypeptide; note = SP265 Variable heavy (vh) domain
VHQSVEESRGGLIKPTDTLTLTCTVSGFSLGSYGVSWVRQAPGNGLEWIGGSGKRGNPYYASWAKSRSTITRNTNLNTVTLKMTSLTAADTATYFCASRAPVVSTSMTFNIWGPGTLVTVSS

SEQ ID NO: 170 - protein, 5 aa, synthetic construct
  source 1..5: note = Description of Artificial Sequence: Synthetic peptide; note = SP265 vhCDR1
SYGVS

SEQ ID NO: 171 - protein, 16 aa, synthetic construct
  source 1..16: note = Description of Artificial Sequence: Synthetic peptide; note = SP265 vhCDR2
GSGKRGNPYYASWAKS

SEQ ID NO: 172 - protein, 13 aa, synthetic construct
  source 1..13: note = Description of Artificial Sequence: Synthetic peptide; note = SP265 vhCDR3
RAPVVSTSMTFNI

SEQ ID NO: 173 - protein, 115 aa, synthetic construct
  source 1..115: note = Description of Artificial Sequence: Synthetic polypeptide; note = SP265 Variable light (vl) domain
VLAQVPTQTPSPVSAAVGGTVTINCQASQSVYNNKNLSWYQQKPGQPPKLLIYEASTLASGVPSRFSGSGSGTQFALTISGVQCEDAATYYCQGEFTCSGADCGAFGGGTEVVVK

SEQ ID NO: 174 - protein, 13 aa, synthetic construct
  source 1..13: note = Description of Artificial Sequence: Synthetic peptide; note = SP265 vlCDR1
QASQSVYNNKNLS

SEQ ID NO: 175 - protein, 7 aa, synthetic construct
  source 1..7: note = Description of Artificial Sequence: Synthetic peptide; note = SP265 vlCDR2
EASTLAS

SEQ ID NO: 176 - protein, 13 aa, synthetic construct
  source 1..13: note = Description of Artificial Sequence: Synthetic peptide; note = SP265 vlCDR3
QGEFTCSGADCGA

SEQ ID NO: 177 - protein, 124 aa, synthetic construct
  source 1..124: note = Description of Artificial Sequence: Synthetic polypeptide; note = S10-H50L58 Variable heavy (vh) domain
VHQEQLEESGGDLVKPGASLTLTCTASGFSFSSSYWICWVRQAPGKGLEWIACIYAGSSLNTYYAPWAKGRFTISKTSSATVTLQMTSLTAADTATYSCARTVVGGWGYALDLWGPGTLVTVSS

SEQ ID NO: 178 - protein, 6 aa, synthetic construct
  source 1..6: note = Description of Artificial Sequence: Synthetic peptide; note = S10-H50L58 vhCDR1
SSYWIC

SEQ ID NO: 179 - protein, 18 aa, synthetic construct
  source 1..18: note = Description of Artificial Sequence: Synthetic peptide; note = S10-H50L58 vhCDR2
CIYAGSSLNTYYAPWAKG

SEQ ID NO: 180 - protein, 12 aa, synthetic construct
  source 1..12: note = Description of Artificial Sequence: Synthetic peptide; note = S10-H50L58 vhCDR3
TVVGGWGYALDL

SEQ ID NO: 181 - protein, 114 aa, synthetic construct
  source 1..114: note = Description of Artificial Sequence: Synthetic polypeptide; note = S10-H50L58 Variable light (vl) domain
VLQVLTQTPSPVSAAVGGTVTINCQASQSVYNNKNLSWYQQKPGQPPKLLIYEASTLASGVPSRFSGSGSGTQFALTISGVQCEDAATYYCQGEFTCSGADCGAFGGGTEVVVK

SEQ ID NO: 182 - protein, 13 aa, synthetic construct
  source 1..13: note = Description of Artificial Sequence: Synthetic peptide; note = S10-H50L58 vlCDR1
QASQSVYNNKNLS

SEQ ID NO: 183 - protein, 7 aa, synthetic construct
  source 1..7: note = Description of Artificial Sequence: Synthetic peptide; note = S10-H50L58 vlCDR2
EASTLAS

SEQ ID NO: 184 - protein, 13 aa, synthetic construct
  source 1..13: note = Description of Artificial Sequence: Synthetic peptide; note = S10-H50L58 vlCDR3
QGEFTCSGADCGA

SEQ ID NO: 185 - protein, 120 aa, synthetic construct
  source 1..120: note = Description of Artificial Sequence: Synthetic polypeptide; note = 8H9 Variable heavy (vh) domain
VHQVKLQQSGAELVKPGASVKLSCKASGYTFTNYDINWVRQRPEQGLEWIGWIFPGDGSTQYNEKFKGKATLTTDTSSSTAYMQLSRLTSEDSAVYFCARQTTATWFAYWGQGTTVTVSS

SEQ ID NO: 186 - protein, 5 aa, synthetic construct
  source 1..5: note = Description of Artificial Sequence: Synthetic peptide; note = 8H9 vhCDR1
NYDIN

SEQ ID NO: 187 - protein, 17 aa, synthetic construct
  source 1..17: note = Description of Artificial Sequence: Synthetic peptide; note = 8H9 vhCDR2
WIFPGDGSTQYNEKFKG

SEQ ID NO: 188 - protein, 9 aa, synthetic construct
  source 1..9: note = Description of Artificial Sequence: Synthetic peptide; note = 8H9 vhCDR3
QTTATWFAY

SEQ ID NO: 189 - protein, 109 aa, synthetic construct
  source 1..109: note = Description of Artificial Sequence: Synthetic polypeptide; note = 8H9 Variable light (vl) domain
VLDIELTQSPTTLSVTPGDRVSLSCRASQSISDYLHWYQQKSHESPRLLIKYASQSISGIPSRFSGSGSGSDFTLSINSVEPEDVGVYYCQNGHSFPLTFGAGTKLELK

SEQ ID NO: 190 - protein, 11 aa, synthetic construct
  source 1..11: note = Description of Artificial Sequence: Synthetic peptide; note = 8H9 vlCDR1
RASQSISDYLH

SEQ ID NO: 191 - protein, 7 aa, synthetic construct
  source 1..7: note = Description of Artificial Sequence: Synthetic peptide; note = 8H9 vlCDR2
YASQSIS

SEQ ID NO: 192 - protein, 9 aa, synthetic construct
  source 1..9: note = Description of Artificial Sequence: Synthetic peptide; note = 8H9 vlCDR3
QNGHSFPLT

SEQ ID NO: 193 - protein, 122 aa, synthetic construct
  source 1..122: note = Description of Artificial Sequence: Synthetic polypeptide; note = m852 Variable heavy (vh) domain
VHQVQLQQSGAEVKKPGSSVKVSCKASGGTFSSYAISWVRQAPGQGLEWMGGIIPILGIANYAQKFQGRVTITADESTSTAYMELSSLRSEDTAVYYCARGRRSGSYYMGYWGQGTLVTVSS

SEQ ID NO: 194 - protein, 5 aa, synthetic construct
  source 1..5: note = Description of Artificial Sequence: Synthetic peptide; note = m852 vhCDR1
SYAIS

SEQ ID NO: 195 - protein, 17 aa, synthetic construct
  source 1..17: note = Description of Artificial Sequence: Synthetic peptide; note = m852 vhCDR2
GIIPILGIANYAQKFQG

SEQ ID NO: 196 - protein, 11 aa, synthetic construct
  source 1..11: note = Description of Artificial Sequence: Synthetic peptide; note = m852 vhCDR3
GRRSGSYYMGY

SEQ ID NO: 197 - protein, 111 aa, synthetic construct
  source 1..111: note = Description of Artificial Sequence: Synthetic polypeptide; note = m852 Variable light (vl) domain
VLEIVLTQSPATLSLSPGERATLSCRASQSVSSNLAWYQQKPGQAPRLLIYDTSTRATGIPARFSGSGSGTEFTLTISSLQSEDFAVYYCQQYNNWPPAYTFGQGTKLEIK

SEQ ID NO: 198 - protein, 11 aa, synthetic construct
  source 1..11: note = Description of Artificial Sequence: Synthetic peptide; note = m852 vlCDR1
RASQSVSSNLA

SEQ ID NO: 199 - protein, 7 aa, synthetic construct
  source 1..7: note = Description of Artificial Sequence: Synthetic peptide; note = m852 vlCDR2
DTSTRAT

SEQ ID NO: 200 - protein, 11 aa, synthetic construct
  source 1..11: note = Description of Artificial Sequence: Synthetic peptide; note = m852 vlCDR3
QQYNNWPPAYT

SEQ ID NO: 201 - protein, 121 aa, synthetic construct
  source 1..121: note = Description of Artificial Sequence: Synthetic polypeptide; note = m857 Variable heavy (vh) domain
VHQVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGSYAFDIWGQGTMVTVSS

SEQ ID NO: 202 - protein, 5 aa, synthetic construct
  source 1..5: note = Description of Artificial Sequence: Synthetic peptide; note = m857 vhCDR1
SYAIS

SEQ ID NO: 203 - protein, 17 aa, synthetic construct
  source 1..17: note = Description of Artificial Sequence: Synthetic peptide; note = m857 vhCDR2
GIIPILGIANYAQKFQG

SEQ ID NO: 204 - protein, 10 aa, synthetic construct
  source 1..10: note = Description of Artificial Sequence: Synthetic peptide; note = m857 vhCDR3
GGSGSYAFDI

SEQ ID NO: 205 - protein, 111 aa, synthetic construct
  source 1..111: note = Description of Artificial Sequence: Synthetic polypeptide; note = m857 Variable light (vl) domain
VLEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIK

SEQ ID NO: 206 - protein, 11 aa, synthetic construct
  source 1..11: note = Description of Artificial Sequence: Synthetic peptide; note = m857 vlCDR1
RASQSVSSYLA

SEQ ID NO: 207 - protein, 7 aa, synthetic construct
  source 1..7: note = Description of Artificial Sequence: Synthetic peptide; note = m857 vlCDR2
DASNRAT

SEQ ID NO: 208 - protein, 11 aa, synthetic construct
  source 1..11: note = Description of Artificial Sequence: Synthetic peptide; note = m857 vlCDR3
QQRSNWPPSYT

SEQ ID NO: 209 - protein, 121 aa, synthetic construct
  source 1..121: note = Description of Artificial Sequence: Synthetic polypeptide; note = m8524 Variable heavy (vh) domain
VHQVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGSGSYHMDVWGKGTTVTVSS

SEQ ID NO: 210 - protein, 5 aa, synthetic construct
  source 1..5: note = Description of Artificial Sequence: Synthetic peptide; note = m8524 vhCDR1
SYAIS

SEQ ID NO: 211 - protein, 17 aa, synthetic construct
  source 1..17: note = Description of Artificial Sequence: Synthetic peptide; note = m8524 vhCDR2
GIIPILGIANYAQKFQG

SEQ ID NO: 212 - protein, 10 aa, synthetic construct
  source 1..10: note = Description of Artificial Sequence: Synthetic peptide; note = m8524 vhCDR3
GGSGSYHMDV

SEQ ID NO: 213 - protein, 111 aa, synthetic construct
  source 1..111: note = Description of Artificial Sequence: Synthetic polypeptide; note = m8524 Variable light (vl) domain
VLEIVLTQSPATLSLSPGERATLSCRASQSVSSYLAWYQQKPGQAPRLLIYDASNRATGIPARFSGSGSGTDFTLTISSLEPEDFAVYYCQQRSNWPPRITFGQGTRLEIK

SEQ ID NO: 214 - protein, 11 aa, synthetic construct
  source 1..11: note = Description of Artificial Sequence: Synthetic peptide; note = m8524 vlCDR1
RASQSVSSYLA

SEQ ID NO: 215 - protein, 7 aa, synthetic construct
  source 1..7: note = Description of Artificial Sequence: Synthetic peptide; note = m8524 vlCDR2
DASNRAT

SEQ ID NO: 216 - protein, 11 aa, synthetic construct
  source 1..11: note = Description of Artificial Sequence: Synthetic peptide; note = m8524 vlCDR3
QQRSNWPPRIT

SEQ ID NO: 217 - protein, 120 aa, synthetic construct
  source 1..120: note = Description of Artificial Sequence: Synthetic polypeptide; note = 1_1 Variable heavy (vh) domain
VHQVQLQQSGAEVKKPGASVKVSCKASGYTFTNYDINWVRQAPGQGLEWIGWIFPGDGSTQYNGKFKGRATLTTDTSTSTAYMELSSLRSEDTAVYFCARQTTGTWFAYWGQGTLVTVSS

SEQ ID NO: 218 - protein, 5 aa, synthetic construct
  source 1..5: note = Description of Artificial Sequence: Synthetic peptide; note = 1_1 vhCDR1
NYDIN

SEQ ID NO: 219 - protein, 17 aa, synthetic construct
  source 1..17: note = Description of Artificial Sequence: Synthetic peptide; note = 1_1 vhCDR2
WIFPGDGSTQYNGKFKG

SEQ ID NO: 220 - protein, 9 aa, synthetic construct
  source 1..9: note = Description of Artificial Sequence: Synthetic peptide; note = 1_1 vhCDR3
QTTGTWFAY

SEQ ID NO: 221 - protein, 109 aa, synthetic construct
  source 1..109: note = Description of Artificial Sequence: Synthetic polypeptide; note = 1_1 Variable light (vl) domain
VLDIVLTQSPATLSLSPGERATLSCRASQSISPYLHWYQQKPGQAPRLLIKYASQSWSGIPARFSGSGSGSDFTLTISSLEPEDFAVYYCQNGHSFPLTFGGGTKVEIK

SEQ ID NO: 222 - protein, 11 aa, synthetic construct
  source 1..11: note = Description of Artificial Sequence: Synthetic peptide; note = 1_1 vlCDR1
RASQSISPYLH

SEQ ID NO: 223 - protein, 7 aa, synthetic construct
  source 1..7: note = Description of Artificial Sequence: Synthetic peptide; note = 1_1 vlCDR2
YASQSWS

SEQ ID NO: 224 - protein, 9 aa, synthetic construct
  source 1..9: note = Description of Artificial Sequence: Synthetic peptide; note = 1_1 vlCDR3
QNGHSFPLT

SEQ ID NO: 225 - protein, 120 aa, synthetic construct
  source 1..120: note = Description of Artificial Sequence: Synthetic polypeptide; note = 1_2 Variable heavy (vh) domain
VHQVQLQQSGAEVKKPGASVKVSCKASGYTFTNYDINWVRQAPGQGLEWIGWIFPGDGSTQYNETFKGRATLTTDTSTSTAYMELSSLRSEDTAVYFCARQTTGTWFAYWGQGTLVTVSS

SEQ ID NO: 226 - protein, 5 aa, synthetic construct
  source 1..5: note = Description of Artificial Sequence: Synthetic peptide; note = 1_2 vhCDR1
NYDIN

SEQ ID NO: 227 - protein, 17 aa, synthetic construct
  source 1..17: note = Description of Artificial Sequence: Synthetic peptide; note = 1_2 vhCDR2
WIFPGDGSTQYNETFKG

SEQ ID NO: 228 - protein, 9 aa, synthetic construct
  source 1..9: note = Description of Artificial Sequence: Synthetic peptide; note = 1_2 vhCDR3
QTTGTWFAY

SEQ ID NO: 229 - protein, 109 aa, synthetic construct
  source 1..109: note = Description of Artificial Sequence: Synthetic polypeptide; note = 1_2 Variable light (vl) domain
VLDIVLTQSPATLSLSPGERATLSCRASQSISKYLHWYQQKPGQAPRLLIKYANQSIRGIPARFSGSGSGSDFTLTISSLEPEDFAVYYCQNGHSFPLTFGGGTKVEIK

SEQ ID NO: 230 - protein, 11 aa, synthetic construct
  source 1..11: note = Description of Artificial Sequence: Synthetic peptide; note = 1_2 vlCDR1
RASQSISKYLH

SEQ ID NO: 231 - protein, 7 aa, synthetic construct
  source 1..7: note = Description of Artificial Sequence: Synthetic peptide; note = 1_2 vlCDR2
YANQSIR

SEQ ID NO: 232 - protein, 9 aa, synthetic construct
  source 1..9: note = Description of Artificial Sequence: Synthetic peptide; note = 1_2 vlCDR3
QNGHSFPLT

SEQ ID NO: 233 - protein, 120 aa, synthetic construct
  source 1..120: note = Description of Artificial Sequence: Synthetic polypeptide; note = 1_4 Variable heavy (vh) domain
VHQVQLQQSGAEVKKPGASVKVSCKASGYTFTNYDINWVRQAPGQGLEWIGWIFPGDGSTQYNPKFKGRATLTTDTSTSTAYMELSSLRSEDTAVYFCARQTTGTWFAYWGQGTLVTVSS

SEQ ID NO: 234 - protein, 5 aa, synthetic construct
  source 1..5: note = Description of Artificial Sequence: Synthetic peptide; note = 1_4 vhCDR1
NYDIN

SEQ ID NO: 235 - protein, 17 aa, synthetic construct
  source 1..17: note = Description of Artificial Sequence: Synthetic peptide; note = 1_4 vhCDR2
WIFPGDGSTQYNPKFKG

SEQ ID NO: 236 - protein, 9 aa, synthetic construct
  source 1..9: note = Description of Artificial Sequence: Synthetic peptide; note = 1_4 vhCDR3
QTTGTWFAY

SEQ ID NO: 237 - protein, 109 aa, synthetic construct
  source 1..109: note = Description of Artificial Sequence: Synthetic polypeptide; note = 1_4 Variable light (vl) domain
VLDIVLTQSPATLSLSPGERATLSCRASQSISTYLHWYQQKPGQAPRLLIKEASQSISGIPARFSGSGSGSDFTLTISSLEPEDFAVYYCQNGHSFPLTFGGGTKVEIK

SEQ ID NO: 238 - protein, 11 aa, synthetic construct
  source 1..11: note = Description of Artificial Sequence: Synthetic peptide; note = 1_4 vlCDR1
RASQSISTYLH

SEQ ID NO: 239 - protein, 7 aa, synthetic construct
  source 1..7: note = Description of Artificial Sequence: Synthetic peptide; note = 1_4 vlCDR2
EASQSIS

SEQ ID NO: 240 - protein, 9 aa, synthetic construct
  source 1..9: note = Description of Artificial Sequence: Synthetic peptide; note = 1_4 vlCDR3
QNGHSFPLT

SEQ ID NO: 241 - protein, 120 aa, synthetic construct
  source 1..120: note = Description of Artificial Sequence: Synthetic polypeptide; note = 1_5 Variable heavy (vh) domain
VHQVQLQQSGAEVKKPGASVKVSCKASGYTFTNYDINWVRQAPGQGLEWIGWIFPGDGSTQYNEKFKGRATLTTDTSTSTAYMELSSLRSEDTAVYFCARQTTGTWFAYWGQGTLVTVSS

SEQ ID NO: 242 - protein, 5 aa, synthetic construct
  source 1..5: note = Description of Artificial Sequence: Synthetic peptide; note = 1_5 vhCDR1
NYDIN

SEQ ID NO: 243 - protein, 17 aa, synthetic construct
  source 1..17: note = Description of Artificial Sequence: Synthetic peptide; note = 1_5 vhCDR2
WIFPGDGSTQYNEKFKG

SEQ ID NO: 244 - protein, 9 aa, synthetic construct
  source 1..9: note = Description of Artificial Sequence: Synthetic peptide; note = 1_5 vhCDR3
QTTGTWFAY

SEQ ID NO: 245 - protein, 109 aa, synthetic construct
  source 1..109: note = Description of Artificial Sequence: Synthetic polypeptide; note = 1_5 Variable light (vl) domain
VLDIVLTQSPATLSLSPGERATLSCRASQSISHYLHWYQQKPGQAPRLLIKYASQSLSGIPARFSGSGSGSDFTLTISSLEPEDFAVYYCQNGHSFPLTFGGGTKVEIK

SEQ ID NO: 246 - protein, 11 aa, synthetic construct
  source 1..11: note = Description of Artificial Sequence: Synthetic peptide; note = 1_5 vlCDR1
RASQSISHYLH

SEQ ID NO: 247 - protein, 7 aa, synthetic construct
  source 1..7: note = Description of Artificial Sequence: Synthetic peptide; note = 1_5 vlCDR2
YASQSLS

SEQ ID NO: 248 - protein, 9 aa, synthetic construct
  source 1..9: note = Description of Artificial Sequence: Synthetic peptide; note = 1_5 vlCDR3
QNGHSFPLT

SEQ ID NO: 249 - protein, 120 aa, synthetic construct
  source 1..120: note = Description of Artificial Sequence: Synthetic polypeptide; note = 1_7 Variable heavy (vh) domain
VHQVQLQQSGAEVKKPGASVKVSCKASGYTYTNYDINWVRQAPGQGLEWIGWIFPGDGSTQYNEKFKGRATLTTDTSTSTAYMELSSLRSEDTAVYFCARQTTGTWFAYWGQGTLVTVSS

SEQ ID NO: 250 - protein, 5 aa, synthetic construct
  source 1..5: note = Description of Artificial Sequence: Synthetic peptide; note = 1_7 vhCDR1
NYDIN

SEQ ID NO: 251 - protein, 17 aa, synthetic construct
  source 1..17: note = Description of Artificial Sequence: Synthetic peptide; note = 1_7 vhCDR2
WIFPGDGSTQYNEKFKG

SEQ ID NO: 252 - protein, 9 aa, synthetic construct
  source 1..9: note = Description of Artificial Sequence: Synthetic peptide; note = 1_7 vhCDR3
QTTGTWFAY

SEQ ID NO: 253 - protein, 109 aa, synthetic construct
  source 1..109: note = Description of Artificial Sequence: Synthetic polypeptide; note = 1_7 Variable light (vl) domain
VLDIVLTQSPATLSLSPGERATLSCRASQSISPYLHWYQQKPGQAPRLLIKHASQSISGIPARFSGSGSGSDFTLTISSLEPEDFAVYYCQNGHSFPLTFGGGTKVEIK

SEQ ID NO: 254 - protein, 11 aa, synthetic construct
  source 1..11: note = Description of Artificial Sequence: Synthetic peptide; note = 1_7 vlCDR1
RASQSISPYLH

SEQ ID NO: 255 - protein, 7 aa, synthetic construct
  source 1..7: note = Description of Artificial Sequence: Synthetic peptide; note = 1_7 vlCDR2
HASQSIS

SEQ ID NO: 256 - protein, 9 aa, synthetic construct
  source 1..9: note = Description of Artificial Sequence: Synthetic peptide; note = 1_7 vlCDR3
QNGHSFPLT

SEQ ID NO: 257 - protein, 120 aa, synthetic construct
  source 1..120: note = Description of Artificial Sequence: Synthetic polypeptide; note = 2_5 Variable heavy (vh) domain
VHQVQLQQSGAEVKKPGASVKVSCKASGYTFTNYDINWVRQAPGQGLEWIGWIFPGDGSTQYNEKFKGRATLTTDTSTSTAYMELSSLRSEDTAVYFCARQTTSTWFAYWGQGTLVTVSS

SEQ ID NO: 258 - protein, 5 aa, synthetic construct
  source 1..5: note = Description of Artificial Sequence: Synthetic peptide; note = 2_5 vhCDR1
NYDIN

SEQ ID NO: 259 - protein, 17 aa, synthetic construct
  source 1..17: note = Description of Artificial Sequence: Synthetic peptide; note = 2_5 vhCDR2
WIFPGDGSTQYNEKFKG

SEQ ID NO: 260 - protein, 9 aa, synthetic construct
  source 1..9: note = Description of Artificial Sequence: Synthetic peptide; note = 2_5 vhCDR3
QTTSTWFAY

SEQ ID NO: 261 - protein, 109 aa, synthetic construct
  source 1..109: note = Description of Artificial Sequence: Synthetic polypeptide; note = 2_5 Variable light (vl) domain
VLDIVLTQSPATLSLSPGERATLSCRASQIISDYLHWYQQKPGQAPRLLIKYASQLISGIPARFSGSGSGSDFTLTISSLEPEDFAVYYCQNGHSFPLTFGGGTKVEIK

SEQ ID NO: 262 - protein, 11 aa, synthetic construct
  source 1..11: note = Description of Artificial Sequence: Synthetic peptide; note = 2_5 vlCDR1
RASQIISDYLH

SEQ ID NO: 263 - protein, 7 aa, synthetic construct
  source 1..7: note = Description of Artificial Sequence: Synthetic peptide; note = 2_5 vlCDR2
YASQLIS

SEQ ID NO: 264 - protein, 9 aa, synthetic construct
  source 1..9: note = Description of Artificial Sequence: Synthetic peptide; note = 2_5 vlCDR3
QNGHSFPLT

SEQ ID NO: 265 - protein, 120 aa, synthetic construct; identical to SEQ ID NO: 241
  source 1..120: note = Description of Artificial Sequence: Synthetic polypeptide; note = 2_8 Variable heavy (vh) domain

SEQ ID NO: 266 - protein, 5 aa, synthetic construct
  source 1..5: note = Description of Artificial Sequence: Synthetic peptide; note = 2_8 vhCDR1
NYDIN

SEQ ID NO: 267 - protein, 17 aa, synthetic construct
  source 1..17: note = Description of Artificial Sequence: Synthetic peptide; note = 2_8 vhCDR2
WIFPGDGSTQYNEKFKG

SEQ ID NO: 268 - protein, 9 aa, synthetic construct
  source 1..9: note = Description of Artificial Sequence: Synthetic peptide; note = 2_8 vhCDR3
QTTGTWFAY

SEQ ID NO: 269 - protein, 109 aa, synthetic construct
  source 1..109: note = Description of Artificial Sequence: Synthetic polypeptide; note = 2_8 Variable light (vl) domain
VLDIVLTQSPATLSLSPGERATLSCRASQSISEYLHWYQQKPGQAPRLLIKHASQSISGIPARFSGSGSGSDFTLTISSLEPEDFAVYYCQNGHSFPLTFGGGTKVEIK

SEQ ID NO: 270 - protein, 11 aa, synthetic construct
  source 1..11: note = Description of Artificial Sequence: Synthetic peptide; note = 2_8 vlCDR1
RASQSISEYLH

SEQ ID NO: 271 - protein, 7 aa, synthetic construct
  source 1..7: note = Description of Artificial Sequence: Synthetic peptide; note = 2_8 vlCDR2
HASQSIS

SEQ ID NO: 272 - protein, 9 aa, synthetic construct
  source 1..9: note = Description of Artificial Sequence: Synthetic peptide; note = 2_8 vlCDR3
QNGHSFPLT

SEQ ID NO: 273 - protein, 122 aa, synthetic construct
  source 1..122: note = Description of Artificial Sequence: Synthetic polypeptide; note = chAb2 Variable heavy (vh) domain
VHQVQLQQPGAELVKPGASVKLSCKASGYTFTSYWMHWVKQRPGQGLEWIGMIHPDSGTTNYNEKFRSKATLTVDKSSSTAYMQLSSLTSEDSAVYYCAVYYGSTYWYFDVWGTGTTVTVSS

SEQ ID NO: 274 - protein, 5 aa, synthetic construct
  source 1..5: note = Description of Artificial Sequence: Synthetic peptide; note = chAb2 vhCDR1
SYWMH

SEQ ID NO: 275 - protein, 17 aa, synthetic construct
  source 1..17: note = Description of Artificial Sequence: Synthetic peptide; note = chAb2 vhCDR2
MIHPDSGTTNYNEKFRS

SEQ ID NO: 276 - protein, 11 aa, synthetic construct
  source 1..11: note = Description of Artificial Sequence: Synthetic peptide; note = chAb2 vhCDR3
YYGSTYWYFDV

SEQ ID NO: 277 - protein, 114 aa, synthetic construct
  source 1..114: note = Description of Artificial Sequence: Synthetic polypeptide; note = chAb2 Variable light (vl) domain
VLDVVMTQTPLSLPVSLGDQAYISCRSSQSLVHINGNTYLHWYRQKPGQSPKLLIYKVSNRFSGVPDRFSGSGSGTDFTLKISRVEAEDLGVYFCSQSTHFPFTFGSGTKLEIK

SEQ ID NO: 278 - protein, 16 aa, synthetic construct
  source 1..16: note = Description of Artificial Sequence: Synthetic peptide; note = chAb2 vlCDR1
RSSQSLVHINGNTYLH

SEQ ID NO: 279 - protein, 7 aa, synthetic construct
  source 1..7: note = Description of Artificial Sequence: Synthetic peptide; note = chAb2 vlCDR2
KVSNRFS

SEQ ID NO: 280 - protein, 9 aa, synthetic construct
  source 1..9: note = Description of Artificial Sequence: Synthetic peptide; note = chAb2 vlCDR3
SQSTHFPFT

SEQ ID NO: 281 - protein, 119 aa, synthetic construct
  source 1..119: note = Description of Artificial Sequence: Synthetic polypeptide; note = chAb3 Variable heavy (vh) domain
VHQVQLQQPGAELVKPGASVKLSCKASGYTFSSYWMHWVKQRPGQGLEWIGLIHPDSGSTNYNEMFKNKATLTVDRSSSTAYVQLSSLTSEDSAVYFCAGGGRLYFDYWGQGTTLTVSS

SEQ ID NO: 282 - protein, 5 aa, synthetic construct
  source 1..5: note = Description of Artificial Sequence: Synthetic peptide; note = chAb3 vhCDR1
SYWMH

SEQ ID NO: 283 - protein, 17 aa, synthetic construct
  source 1..17: note = Description of Artificial Sequence: Synthetic peptide; note = chAb3 vhCDR2
LIHPDSGSTNYNEMFKN

SEQ ID NO: 284 - protein, 8 aa, synthetic construct
  source 1..8: note = Description of Artificial Sequence: Synthetic peptide; note = chAb3 vhCDR3
GGRLYFDY

SEQ ID NO: 285 - protein, 114 aa, synthetic construct
  source 1..114: note = Description of Artificial Sequence: Synthetic polypeptide; note = chAb3 Variable light (vl) domain
VLDVVMTQTPLSLPVSLGDQASISCRSSQSLVHSNGDTYLRWYLQKPGQSPKLLIYKVSNRFSGVPDRFSGSGSGTDFTLKITRVEAEDLGVYFCSQSTHVPYTFGGGTKLEIK

SEQ ID NO: 286 - protein, 16 aa, synthetic construct
  source 1..16: note = Description of Artificial Sequence: Synthetic peptide; note = chAb3 vlCDR1
RSSQSLVHSNGDTYLR

SEQ ID NO: 287 - protein, 7 aa, synthetic construct
  source 1..7: note = Description of Artificial Sequence: Synthetic peptide; note = chAb3 vlCDR2
KVSNRFS

SEQ ID NO: 288 - protein, 9 aa, synthetic construct
  source 1..9: note = Description of Artificial Sequence: Synthetic peptide; note = chAb3 vlCDR3
SQSTHVPYT

SEQ ID NO: 289 - protein, 119 aa, synthetic construct
  source 1..119: note = Description of Artificial Sequence: Synthetic polypeptide; note = chAb4 Variable heavy (vh) domain
VHQVQLQQPGAELVKPGASVKLSCKASGYSFTSYWMHWVKQRPGQGLEWIGMIHPNSGSNNYNEKFKSKATLTVDKSSNTAYMQLSSLTSEDSAVYYCARRLGLHFDYWGQGTTLTVSS

SEQ ID NO: 290 - protein, 5 aa, synthetic construct
  source 1..5: note = Description of Artificial Sequence: Synthetic peptide; note = chAb4 vhCDR1
SYWMH

SEQ ID NO: 291 - protein, 17 aa, synthetic construct
  source 1..17: note = Description of Artificial Sequence: Synthetic peptide; note = chAb4 vhCDR2
MIHPNSGSNNYNEKFKS

SEQ ID NO: 292 - protein, 8 aa, synthetic construct
  source 1..8: note = Description of Artificial Sequence: Synthetic peptide; note = chAb4 vhCDR3
RLGLHFDY

SEQ ID NO: 293 - protein, 107 aa, synthetic construct
  source 1..107: note = Description of Artificial Sequence: Synthetic polypeptide; note = chAb4 Variable light (vl) domain
DIVMTQSQKFMSTPVGDRVSITCKASQNVGTAVAWYQQKPGQSPKLLIYSASNRYTGVPDRFTGSGSGTDFTLTISNMQSEDLADYFCQQYSSYPYTFGGGTKLEIK

SEQ ID NO: 294 - protein, 11 aa, synthetic construct
  source 1..11: note = Description of Artificial Sequence: Synthetic peptide; note = chAb4 vlCDR1
KASQNVGTAVA

SEQ ID NO: 295 - protein, 7 aa, synthetic construct
  source 1..7: note = Description of Artificial Sequence: Synthetic peptide; note = chAb4 vlCDR2
SASNRYT

SEQ ID NO: 296 - protein, 9 aa, synthetic construct
  source 1..9: note = Description of Artificial Sequence: Synthetic peptide; note = chAb4 vlCDR3
QQYSSYPYT

SEQ ID NO: 297 - protein, 121 aa, synthetic construct
  source 1..121: note = Description of Artificial Sequence: Synthetic polypeptide; note = chAb18 Variable heavy (vh) domain
QVQLQQSAAELARPGASVKMSCKASGYSFTSYTIHWVKQRPGQGLEWIGYINPNSRNTDYNQKFKDETTLTADRSSSTAYMQLISLTSEDSAVYYCARYSGSTPYWYFDVWGAGTTVTVSS

SEQ ID NO: 298 - protein, 5 aa, synthetic construct
  source 1..5: note = Description of Artificial Sequence: Synthetic peptide; note = chAb18 vhCDR1
SYTIH

SEQ ID NO: 299 - protein, 17 aa, synthetic construct
  source 1..17: note = Description of Artificial Sequence: Synthetic peptide; note = chAb18 vhCDR2
YINPNSRNTDYNQKFKD

SEQ ID NO: 300 - protein, 12 aa, synthetic construct
  source 1..12: note = Description of Artificial Sequence: Synthetic peptide; note = chAb18 vhCDR3
YSGSTPYWYFDV

SEQ ID NO: 301 - protein, 106 aa, synthetic construct
  source 1..106: note = Description of Artificial Sequence: Synthetic polypeptide; note = chAb18 Variable light (vl) domain
QIVLTQSPAILSASPGEKVTMTCRASSSVSYMNWYQQKPGSSPKPWIYATSNLASGVPARFSVSVSGTSHSLTISRVEAEDAATYYCQQWSSNPLTFGAGTKLELK

SEQ ID NO: 302 - protein, 10 aa, synthetic construct
  source 1..10: note = Description of Artificial Sequence: Synthetic peptide; note = chAb18 vlCDR1
RASSSVSYMN

SEQ ID NO: 303 - protein, 7 aa, synthetic construct
  source 1..7: note = Description of Artificial Sequence: Synthetic peptide; note = chAb18 vlCDR2
ATSNLAS

SEQ ID NO: 304 - protein, 9 aa, synthetic construct
  source 1..9: note = Description of Artificial Sequence: Synthetic peptide; note = chAb18 vlCDR3
QQWSSNPLT

SEQ ID NO: 305 - protein, 116 aa, synthetic construct
  source 1..116: note = Description of Artificial Sequence: Synthetic polypeptide; note = chAb13 Variable heavy (vh) domain
DVQLQESGPDLVKPSQSLSLTCTVTGYSITSGYSWHWIRQFPGNKLEWMGYIHSSGSTNYNPSLKSRISINRDTSKNQFFLQLNSVTTEDTATYYCAGYDDYFEYWGQGTTLTVSS

SEQ ID NO: 306 - protein, 6 aa, synthetic construct
  source 1..6: note = Description of Artificial Sequence: Synthetic peptide; note = chAb13 vhCDR1
SGYSWH

SEQ ID NO: 307 - protein, 16 aa, synthetic construct
  source 1..16: note = Description of Artificial Sequence: Synthetic peptide; note = chAb13 vhCDR2
YIHSSGSTNYNPSLKS

SEQ ID NO: 308 - protein, 7 aa, synthetic construct
  source 1..7: note = Description of Artificial Sequence: Synthetic peptide; note = chAb13 vhCDR3
YDDYFEY

SEQ ID NO: 309 - protein, 107 aa, synthetic construct
  source 1..107: note = Description of Artificial Sequence: Synthetic polypeptide; note = chAb13 Variable light (vl) domain
DIVMTQSQKFMSTSVGDRVSVTCKASQNVGFNVAWYQQKPGQSPKALIYSASYRYSGVPDRFTGSGSGTDFTLTISNVQSEDLAEYFCQQYNSYPFTFGSGTKLEIK

SEQ ID NO: 310 - protein, 11 aa, synthetic construct
  source 1..11: note = Description of Artificial Sequence: Synthetic peptide; note = chAb13 vlCDR1
KASQNVGFNVA

SEQ ID NO: 311 - protein, 7 aa, synthetic construct
  source 1..7: note = Description of Artificial Sequence: Synthetic peptide; note = chAb13 vlCDR2
SASYRYS

SEQ ID NO: 312 - protein, 9 aa, synthetic construct
  source 1..9: note = Description of Artificial Sequence: Synthetic peptide; note = chAb13 vlCDR3
QQYNSYPFT

SEQ ID NO: 313 - protein, 118 aa, synthetic construct
  source 1..118: note = Description of Artificial Sequence: Synthetic polypeptide; note = chAb12 Variable heavy (vh) domain
EVQLVESGGGLVKPGGSLKLSCAASGFTFSSYAMSWVRQTPEKRLEWVATISSGTNYTYYPDSVKGRFTISRDNAKNTLYLQMTSLRSEDTAMYYCARQGRYSWIAYWGQGTLVTVSA

SEQ ID NO: 314 - protein, 5 aa, synthetic construct
  source 1..5: note = Description of Artificial Sequence: Synthetic peptide; note = chAb12 vhCDR1
SYAMS

SEQ ID NO: 315 - protein, 17 aa, synthetic construct
  source 1..17: note = Description of Artificial Sequence: Synthetic peptide; note = chAb12 vhCDR2
TISSGTNYTYYPDSVKG

SEQ ID NO: 316 - protein, 9 aa, synthetic construct
  source 1..9: note = Description of Artificial Sequence: Synthetic peptide; note = chAb12 vhCDR3
QGRYSWIAY

SEQ ID NO: 317 - protein, 110 aa, synthetic construct
  source 1..110: note = Description of Artificial Sequence: Synthetic polypeptide; note = chAb12 Variable light (vl) domain
DIVLTQSPASLAVSLGQRATISCRASKSVSTSDYSYMHWNQQKPGQPPKLLIYLASNLESGVPARFSGSGSGTDFTLNIHPVEEEDAATYYCQHSRELLTFGAGTKLELK

SEQ ID NO: 318 - protein, 15 aa, synthetic construct
  source 1..15: note = Description of Artificial Sequence: Synthetic peptide; note = chAb12 vlCDR1
RASKSVSTSDYSYMH

SEQ ID NO: 319 - protein, 7 aa, synthetic construct
  source 1..7: note = Description of Artificial Sequence: Synthetic peptide; note = chAb12 vlCDR2
LASNLES

SEQ ID NO: 320 - protein, 8 aa, synthetic construct
  source 1..8: note = Description of Artificial Sequence: Synthetic peptide; note = chAb12 vlCDR3
QHSRELLT

SEQ ID NO: 321 - protein, 118 aa, synthetic construct
  source 1..118: note = Description of Artificial Sequence: Synthetic polypeptide; note = chAb14 Variable heavy (vh) domain
EVKLVESGGGLVKPGGSLKLSCAASGFTFSSYGMSWVRQTPEKRLEWVATISGGGTNTYYPDSVEGRFTISRDNAKNFLYLQMSSLRSEDTALYYCARHYGSQTMDYWGQGTSVTVSS

SEQ ID NO: 322 - protein, 5 aa, synthetic construct
  source 1..5: note = Description of Artificial Sequence: Synthetic peptide; note = chAb14 vhCDR1
SYGMS

SEQ ID NO: 323 - protein, 17 aa, synthetic construct
  source 1..17: note = Description of Artificial Sequence: Synthetic peptide; note = chAb14 vhCDR2
TISGGGTNTYYPDSVEG

SEQ ID NO: 324 - protein, 9 aa, synthetic construct
  source 1..9: note = Description of Artificial Sequence: Synthetic peptide; note = chAb14 vhCDR3
HYGSQTMDY

SEQ ID NO: 325 - protein, 107 aa, synthetic construct
  source 1..107: note = Description of Artificial Sequence: Synthetic polypeptide; note = chAb14 Variable light (vl) domain
DIQMTQSPASLSASVGETVTITCRTSGNIHNYLTWYQQKQGKSPQLLVYNAKTLADGVPSRFSGSGSGTQFSLKINSLQPEDFGSYYCQHFWSIMWTFGGGTKLEIK

SEQ ID NO: 326 - protein, 11 aa, synthetic construct
  source 1..11: note = Description of Artificial Sequence: Synthetic peptide; note = chAb14 vlCDR1
RTSGNIHNYLT

SEQ ID NO: 327 - protein, 7 aa, synthetic construct
  source 1..7: note = Description of Artificial Sequence: Synthetic peptide; note = chAb14 vlCDR2
NAKTLAD

SEQ ID NO: 328 - protein, 9 aa, synthetic construct
  source 1..9: note = Description of Artificial Sequence: Synthetic peptide; note = chAb14 vlCDR3
QHFWSIMWT

SEQ ID NO: 329 - protein, 121 aa, synthetic construct
  source 1..121: note = Description of Artificial Sequence: Synthetic polypeptide; note = chAb6 Variable heavy (vh) domain
QVQLQQSGAELMKPGASVKISCKATGYTFSRYWIEWVKQRPGHGLEWIGEILPGSGSTNYNEKFKGKATFTADTSSNTAYMQVSSLTSEDSAVHYCARRGYGYVPYALDYWGQGTSVTVSS

SEQ ID NO: 330 - protein, 5 aa, synthetic construct
  source 1..5: note = Description of Artificial Sequence: Synthetic peptide; note = chAb6 vhCDR1
RYWIE

SEQ ID NO: 331 - protein, 17 aa, synthetic construct
  source 1..17: note = Description of Artificial Sequence: Synthetic peptide; note = chAb6 vhCDR2
EILPGSGSTNYNEKFKG

SEQ ID NO: 332 - protein, 12 aa, synthetic construct
  source 1..12: note = Description of Artificial Sequence: Synthetic peptide; note = chAb6 vhCDR3
RGYGYVPYALDY

SEQ ID NO: 333 - protein, 107 aa, synthetic construct
  source 1..107: note = Description of Artificial Sequence: Synthetic polypeptide; note = chAb6 Variable light (vl) domain
EIQMTQTTSSLSASLGDRVTISCRASQDISNSLNWYQQKPDGTVNLLIYYTSRLYSGVPSRFSGSGSGTDYSLTISNLEQEDIATYFCQQGNTLPYTFGGGTKLEIK

SEQ ID NO: 334 - protein, 11 aa, synthetic construct
  source 1..11: note = Description of Artificial Sequence: Synthetic peptide; note = chAb6 vlCDR1
RASQDISNSLN

SEQ ID NO: 335 - protein, 7 aa, synthetic construct
  source 1..7: note = Description of Artificial Sequence: Synthetic peptide; note = chAb6 vlCDR2
YTSRLYS

SEQ ID NO: 336 - protein, 9 aa, synthetic construct
  source 1..9: note = Description of Artificial Sequence: Synthetic peptide; note = chAb6 vlCDR3
QQGNTLPYT

SEQ ID NO: 337 - protein, 120 aa, synthetic construct
  source 1..120: note = Description of Artificial Sequence: Synthetic polypeptide; note = chAb11 Variable heavy (vh) domain
EVKLVESGGGLVQPGGSLRLSCATSGFTFTNYYMSWVRQPPGKALEWLGFIRNKANDYTTEYSASVKGRFTISRDNSQSILYLQMNTLRAEDSATYYCARESPGNPFAYWGQGTLVTVSA

SEQ ID NO: 338 - protein, 5 aa, synthetic construct
  source 1..5: note = Description of Artificial Sequence: Synthetic peptide; note = chAb11 vhCDR1
NYYMS

SEQ ID NO: 339 - protein, 19 aa, synthetic construct
  source 1..19: note = Description of Artificial Sequence: Synthetic peptide; note = chAb11 vhCDR2
FIRNKANDYTTEYSASVKG

SEQ ID NO: 340 - protein, 9 aa, synthetic construct
  source 1..9: note = Description of Artificial Sequence: Synthetic peptide; note = chAb11 vhCDR3
ESPGNPFAY

SEQ ID NO: 341 - protein, 113 aa, synthetic construct
  source 1..113: note = Description of Artificial Sequence: Synthetic polypeptide; note = chAb11 Variable light (vl) domain
DIVMTQSPSSLTVTAGEKVTMTCKSSQSLLNSGTQKNFLTWYQQKPGQPPKLLIYWASTRESGVPDRFTGSGSGTDFTLTISSVQAEDLAVYFCQNDYIYPLTFGAGTKLELK

SEQ ID NO: 342 - protein, 17 aa, synthetic construct
  source 1..17: note = Description of Artificial Sequence: Synthetic peptide; note = chAb11 vlCDR1
KSSQSLLNSGTQKNFLT

SEQ ID NO: 343 - protein, 7 aa, synthetic construct
  source 1..7: note = Description of Artificial Sequence: Synthetic peptide; note = chAb11 vlCDR2
WASTRES

SEQ ID NO: 344 - protein, 9 aa, synthetic construct
  source 1..9: note = Description of Artificial Sequence: Synthetic peptide; note = chAb11 vlCDR3
QNDYIYPLT

SEQ ID NO: 345 - protein, 121 aa, synthetic construct
  source 1..121: note = Description of Artificial Sequence: Synthetic polypeptide; note = chAb16 Variable heavy (vh) domain
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGFGNYIYAMDYWGQGTSVTVSS

SEQ ID NO: 346 - protein, 5 aa, synthetic construct
  source 1..5: note = Description of Artificial Sequence: Synthetic peptide; note = chAb16 vhCDR1
RYWMS

SEQ ID NO: 347 - protein, 17 aa, synthetic construct
  source 1..17: note = Description of Artificial Sequence: Synthetic peptide; note = chAb16 vhCDR2
EINPDSSTINYTPSLKD

SEQ ID NO: 348 - protein, 12 aa, synthetic construct
  source 1..12: note = Description of Artificial Sequence: Synthetic peptide; note = chAb16 vhCDR3
PGFGNYIYAMDY

SEQ ID NO: 349 - protein, 107 aa, synthetic construct
  source 1..107: note = Description of Artificial Sequence: Synthetic polypeptide; note = chAb16 Variable light (vl) domain
DIQMTQTTSSLSASLGDRVTINCRASQDISNFLNWYQQKPDGTVKLLIYYTSRLYLGVPSRFSGSGSGTDYSLTISNLEQEDIATYFCQQGNTLPPTFGGGTKLEIK

SEQ ID NO: 350 - protein, 11 aa, synthetic construct
  source 1..11: note = Description of Artificial Sequence: Synthetic peptide; note = chAb16 vlCDR1
RASQDISNFLN

SEQ ID NO: 351 - protein, 7 aa, synthetic construct
  source 1..7: note = Description of Artificial Sequence: Synthetic peptide; note = chAb16 vlCDR2
YTSRLYL

SEQ ID NO: 352 - protein, 9 aa, synthetic construct
  source 1..9: note = Description of Artificial Sequence: Synthetic peptide; note = chAb16 vlCDR3
QQGNTLPPT

SEQ ID NO: 353 - protein, 125 aa, synthetic construct
  source 1..125: note = Description of Artificial Sequence: Synthetic polypeptide; note = chAb10 Variable heavy (vh) domain
DVQLQESGPGLVKPSQSLSLTCTVTGYSITSDYAWNWIRQFPGNRLEWMGHINYSGITNYNPSLKSRISITRDTSKNQFFLQLYSVTTEDTATYFCARRSLFYYYGSSLYAMDYWGQGTSVTVSS

SEQ ID NO: 354 - protein, 6 aa, synthetic construct
  source 1..6: note = Description of Artificial Sequence: Synthetic peptide; note = chAb10 vhCDR1
SDYAWN

SEQ ID NO: 355 - protein, 16 aa, synthetic construct
  source 1..16: note = Description of Artificial Sequence: Synthetic peptide; note = chAb10 vhCDR2
HINYSGITNYNPSLKS

SEQ ID NO: 356 - protein, 16 aa, synthetic construct
  source 1..16: note = Description of Artificial Sequence: Synthetic peptide; note = chAb10 vhCDR3
RSLFYYYGSSLYAMDY

SEQ ID NO: 357 - protein, 112 aa, synthetic construct
  source 1..112: note = Description of Artificial Sequence: Synthetic polypeptide; note = chAb10 Variable light (vl) domain
DVVMTQSPFSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 358 - protein, 16 aa, synthetic construct
  source 1..16: note = Description of Artificial Sequence: Synthetic peptide; note = chAb10 vlCDR1
RSSQSLVHSNGNTYLH

SEQ ID NO: 359 - protein, 7 aa, synthetic construct
  source 1..7: note = Description of Artificial Sequence: Synthetic peptide; note = chAb10 vlCDR2
KVSNRFS

SEQ ID NO: 360 - protein, 9 aa, synthetic construct
  source 1..9: note = Description of Artificial Sequence: Synthetic peptide; note = chAb10 vlCDR3
SQSTHVPWT

SEQ ID NO: 361 - protein, 119 aa, synthetic construct
  source 1..119: note = Description of Artificial Sequence: Synthetic polypeptide; note = chAb7 Variable heavy (vh) domain
EVQLVESGENLVKPGGSLKLSCAASGFSFRGYGMSWVRQTPDKRLEWVAAISTGGNYTYYPDSVQGRFTISRDNANNTLYLQMSSLKSEDTAMYYCARRGGNYAGFAYWGQGTLVTVSA

SEQ ID NO: 362 - protein, 5 aa, synthetic construct
  source 1..5: note = Description of Artificial Sequence: Synthetic peptide; note = chAb7 vhCDR1
GYGMS

SEQ ID NO: 363 - protein, 17 aa, synthetic construct
  source 1..17: note = Description of Artificial Sequence: Synthetic peptide; note = chAb7 vhCDR2
AISTGGNYTYYPDSVQG

SEQ ID NO: 364 - protein, 10 aa, synthetic construct
  source 1..10: note = Description of Artificial Sequence: Synthetic peptide; note = chAb7 vhCDR3
RGGNYAGFAY

SEQ ID NO: 365 - protein, 107 aa, synthetic construct
  source 1..107: note = Description of Artificial Sequence: Synthetic polypeptide; note = chAb7 Variable light (vl) domain
DIQMTQSPASLSVSVGETVTITCRPSENIYSNLAWYQQKQGKSPQLLVYAATNLADGVPSRFSGSGSGTQYSLKINSLQSEDFGTYYCQHFWGTPFTFGSGTKLEIK

SEQ ID NO: 366 - protein, 11 aa, synthetic construct
  source 1..11: note = Description of Artificial Sequence: Synthetic peptide; note = chAb7 vlCDR1
RPSENIYSNLA

SEQ ID NO: 367 - protein, 7 aa, synthetic construct
  source 1..7: note = Description of Artificial Sequence: Synthetic peptide; note = chAb7 vlCDR2
AATNLAD

SEQ ID NO: 368 - protein, 9 aa, synthetic construct
  source 1..9: note = Description of Artificial Sequence: Synthetic peptide; note = chAb7 vlCDR3
QHFWGTPFT

SEQ ID NO: 369 - protein, 121 aa, synthetic construct
  source 1..121: note = Description of Artificial Sequence: Synthetic polypeptide; note = chAb8 Variable heavy (vh) domain
EVKLVESGGGLVKPGGSLKLSCAASGFTFSSYGMSWVRQTPEKRLEWVATISGGGNYTYCPDSVKGRFTISRDNAKNNLYLQMSSLRSEDTALYYCTRQRGYDYHYAMDFWGQGTSVTVSS

SEQ ID NO: 370 - protein, 5 aa, synthetic construct
  source 1..5: note = Description of Artificial Sequence: Synthetic peptide; note = chAb8 vhCDR1
SYGMS

SEQ ID NO: 371 - protein, 17 aa, synthetic construct
  source 1..17: note = Description of Artificial Sequence: Synthetic peptide; note = chAb8 vhCDR2
TISGGGNYTYCPDSVKG

SEQ ID NO: 372 - protein, 12 aa, synthetic construct
  source 1..12: note = Description of Artificial Sequence: Synthetic peptide; note = chAb8 vhCDR3
QRGYDYHYAMDF

SEQ ID NO: 373 - protein, 107 aa, synthetic construct
  source 1..107: note = Description of Artificial Sequence: Synthetic polypeptide; note = chAb8 Variable light (vl) domain
DIQMTQSPASLSVSVGETVTITCRASENIYSNLAWHQQKQGKSPQLLVYAATNLADGVPSRFSGNGSDTQYSLKINSLQSEDFGSYFCQNFWGTSWTFGGGTKLEIK

SEQ ID NO: 374 - protein, 11 aa, synthetic construct
  source 1..11: note = Description of Artificial Sequence: Synthetic peptide; note = chAb8 vlCDR1
RASENIYSNLA

SEQ ID NO: 375 - protein, 7 aa, synthetic construct
  source 1..7: note = Description of Artificial Sequence: Synthetic peptide; note = chAb8 vlCDR2
AATNLAD

SEQ ID NO: 376 - protein, 9 aa, synthetic construct
  source 1..9: note = Description of Artificial Sequence: Synthetic peptide; note = chAb8 vlCDR3
QNFWGTSWT

SEQ ID NO: 377 - protein, 117 aa, synthetic construct
  source 1..117: note = Description of Artificial Sequence: Synthetic polypeptide; note = chAb17 Variable heavy (vh) domain
EVKLVESGGGLVQPGGSLKLSCAASGFTFSSYIMSWVRQTPEKRLEWVASIVSSNITYYPDSMKGRFTISRDNARNILYLQMSSLKSEDTAMYYCARSGTRAWFAYWGQGTLVTVSA

SEQ ID NO: 378 - protein, 5 aa, synthetic construct
  source 1..5: note = Description of Artificial Sequence: Synthetic peptide; note = chAb17 vhCDR1
SYIMS

SEQ ID NO: 379 - protein, 16 aa, synthetic construct
  source 1..16: note = Description of Artificial Sequence: Synthetic peptide; note = chAb17 vhCDR2
SIVSSNITYYPDSMKG

SEQ ID NO: 380 - protein, 9 aa, synthetic construct
  source 1..9: note = Description of Artificial Sequence: Synthetic peptide; note = chAb17 vhCDR3
SGTRAWFAY

SEQ ID NO: 381 - protein, 111 aa, synthetic construct
  source 1..111: note = Description of Artificial Sequence: Synthetic polypeptide; note = chAb17 Variable light (vl) domain
DIVLTQSPASLAVSLGQRATISCRASKSVSTSAYSYMHWYQQKPGQPPKLLIYLASNLESGVPARFSGSGSGTDFTLNIHPVEEEDAATYYCQHSRELPYTFGGGTKLEIK

SEQ ID NO: 382 - protein, 15 aa, synthetic construct
  source 1..15: note = Description of Artificial Sequence: Synthetic peptide; note = chAb17 vlCDR1
RASKSVSTSAYSYMH

SEQ ID NO: 383 - protein, 7 aa, synthetic construct
  source 1..7: note = Description of Artificial Sequence: Synthetic peptide; note = chAb17 vlCDR2
LASNLES

SEQ ID NO: 384 - protein, 9 aa, synthetic construct
  source 1..9: note = Description of Artificial Sequence: Synthetic peptide; note = chAb17 vlCDR3
QHSRELPYT

SEQ ID NO: 385 - protein, 118 aa, synthetic construct
  source 1..118: note = Description of Artificial Sequence: Synthetic polypeptide; note = chAb5 Variable heavy (vh) domain
QVQLQQPGDELVKPGASVKLSCKTSGYTFTTDWMHWVKQRPGQGLEWIGMIHPNSGTTNYNEKFKSKAALTVDKSSSTACMQLSSLTSEDSAVYYCARSYWKWYFDVWGTGTTVTVSS

SEQ ID NO: 386 - protein, 5 aa, synthetic construct
  source 1..5: note = Description of Artificial Sequence: Synthetic peptide; note = chAb5 vhCDR1
TDWMH

SEQ ID NO: 387 - protein, 17 aa, synthetic construct
  source 1..17: note = Description of Artificial Sequence: Synthetic peptide; note = chAb5 vhCDR2
MIHPNSGTTNYNEKFKS

SEQ ID NO: 388 - protein, 9 aa, synthetic construct
  source 1..9: note = Description of Artificial Sequence: Synthetic peptide; note = chAb5 vhCDR3
SYWKWYFDV

SEQ ID NO: 389 - protein, 106 aa, synthetic construct
  source 1..106: note = Description of Artificial Sequence: Synthetic polypeptide; note = chAb5 Variable light (vl) domain
QIVLTQSPAIMSASLGEEITLTCSASSSVSYMHWYQQKSGTSPKLLIYSTSNLASGVPSRFSGSGSGTFYSLTISSVEAEDSADYYCHQWTSYMYTFGGGTKLEIK

SEQ ID NO: 390 - protein, 10 aa, synthetic construct
  source 1..10: note = Description of Artificial Sequence: Synthetic peptide; note = chAb5 vlCDR1
SASSSVSYMH

SEQ ID NO: 391 - protein, 7 aa, synthetic construct
  source 1..7: note = Description of Artificial Sequence: Synthetic peptide; note = chAb5 vlCDR2
STSNLAS

SEQ ID NO: 392 - protein, 9 aa, synthetic construct
  source 1..9: note = Description of Artificial Sequence: Synthetic peptide; note = chAb5 vlCDR3
HQWTSYMYT

SEQ ID NO: 393 - protein, 117 aa, synthetic construct
  source 1..117: note = Description of Artificial Sequence: Synthetic polypeptide; note = huAb3v2.5 Variable heavy (vh) domain
EVQLVQSGAEVKKPGSSVKVSCKASGYTFSSYWMHWVRQAPGQGLEWIGLIHPESGSTNYNEMFKNRATLTVDRSTSTAYMELSSLRSEDTAVYYCAGGGRLYFDYWGQGTTVTVSS

SEQ ID NO: 394 - protein, 5 aa, synthetic construct
  source 1..5: note = Description of Artificial Sequence: Synthetic peptide; note = huAb3v2.5 vhCDR1
SYWMH

SEQ ID NO: 395 - protein, 17 aa, synthetic construct
  source 1..17: note = Description of Artificial Sequence: Synthetic peptide; note = huAb3v2.5 vhCDR2
LIHPESGSTNYNEMFKN

SEQ ID NO: 396 - protein, 8 aa, synthetic construct
  source 1..8: note = Description of Artificial Sequence: Synthetic peptide; note = huAb3v2.5 vhCDR3
GGRLYFDY

SEQ ID NO: 397 - protein, 112 aa, synthetic construct
  source 1..112: note = Description of Artificial Sequence: Synthetic polypeptide; note = huAb3v2.5 Variable light (vl) domain
DIVMTQSPLSLPVTPGEPASISCRSSQSLVHSNRDTYLRWYLQKPGQSPQLLIYKVSNRFSGVPDRFSGSGSGTDFTLKISRVEAEDVGVYYCSQSTHVPYTFGGGTKVEIK

SEQ ID NO: 398 - protein, 16 aa, synthetic construct
  source 1..16: note = Description of Artificial Sequence: Synthetic peptide; note = huAb3v2.5 vlCDR1
RSSQSLVHSNRDTYLR

SEQ ID NO: 399 - protein, 7 aa, synthetic construct
  source 1..7: note = Description of Artificial Sequence: Synthetic peptide; note = huAb3v2.5 vlCDR2
KVSNRFS

SEQ ID NO: 400 - protein, 9 aa, synthetic construct
  source 1..9: note = Description of Artificial Sequence: Synthetic peptide; note = huAb3v2.5 vlCDR3
SQSTHVPYT

SEQ ID NO: 401 - protein, 117 aa, synthetic construct; identical to SEQ ID NO: 393
  source 1..117: note = Description of Artificial Sequence: Synthetic polypeptide; note = huAb3v2.6 Variable heavy (vh) domain

SEQ ID NO: 402 - protein, 5 aa, synthetic construct
  source 1..5: note = Description of Artificial Sequence: Synthetic peptide; note = huAb3v2.6 vhCDR1
SYWMH

SEQ ID NO: 403 - protein, 17 aa, synthetic construct
  source 1..17: note = Description of Artificial Sequence: Synthetic peptide; note = huAb3v2.6 vhCDR2
LIHPESGSTNYNEMFKN

SEQ ID NO: 404 - protein, 8 aa, synthetic construct
  source 1..8: note = Description of Artificial Sequence: Synthetic peptide; note = huAb3v2.6 vhCDR3
GGRLYFDY

SEQ ID NO: 405 - protein, 112 aa, synthetic construct
  source 1..112: note = Description of Artificial Sequence: Synthetic polypeptide; note = huAb3v2.6 Variable light (vl) domain
DIVMTQSPLSLPVTPGEPASISCRSSQSLVHSNQDTYLRWYLQKPGQSPQLLIYKVSNRFSGVPDRFSGSGSGTDFTLKISRVEAEDVGVYYCSQSTHVPYTFGGGTKVEIK

SEQ ID NO: 406 - protein, 16 aa, synthetic construct
  source 1..16: note = Description of Artificial Sequence: Synthetic peptide; note = huAb3v2.6 vlCDR1
RSSQSLVHSNQDTYLR

SEQ ID NO: 407 - protein, 7 aa, synthetic construct
  source 1..7: note = Description of Artificial Sequence: Synthetic peptide; note = huAb3v2.6 vlCDR2
KVSNRFS

SEQ ID NO: 408 - protein, 9 aa, synthetic construct
  source 1..9: note = Description of Artificial Sequence: Synthetic peptide; note = huAb3v2.6 vlCDR3
SQSTHVPYT

SEQ ID NO: 409 - protein, 116 aa, synthetic construct
  source 1..116: note = Description of Artificial Sequence: Synthetic polypeptide; note = huAb13v1 Variable heavy (vh) domain
EVQLQESGPGLVKPSETLSLTCAVTGYSITSGYSWHWIRQFPGNGLEWMGYIHSSGSTNYNPSLKSRISISRDTSKNQFFLKLSSVTAADTAVYYCAGYDDYFEYWGQGTTVTVSS

SEQ ID NO: 410 - protein, 6 aa, synthetic construct
  source 1..6: note = Description of Artificial Sequence: Synthetic peptide; note = huAb13v1 vhCDR1
SGYSWH

SEQ ID NO: 411 - protein, 16 aa, synthetic construct
  source 1..16: note = Description of Artificial Sequence: Synthetic peptide; note = huAb13v1 vhCDR2
YIHSSGSTNYNPSLKS

SEQ ID NO: 412 - protein, 7 aa, synthetic construct
  source 1..7: note = Description of Artificial Sequence: Synthetic peptide; note = huAb13v1 vhCDR3
YDDYFEY

SEQ ID NO: 413 - protein, 107 aa, synthetic construct
  source 1..107: note = Description of Artificial Sequence: Synthetic polypeptide; note = huAb13v1 Variable light (vl) domain
DIQMTQSPSSLSASVGDRVTITCKASQNVGFNVAWYQQKPGKSPKALIYSASYRYSGVPSRFSGSGSGTDFTLTISSLQPEDFAEYFCQQYNWYPFTFGQGTKLEIK

SEQ ID NO: 414 - protein, 11 aa, synthetic construct
  source 1..11: note = Description of Artificial Sequence: Synthetic peptide; note = huAb13v1 vlCDR1
KASQNVGFNVA

SEQ ID NO: 415 - protein, 7 aa, synthetic construct
  source 1..7: note = Description of Artificial Sequence: Synthetic peptide; note = huAb13v1 vlCDR2
SASYRYS

SEQ ID NO: 416 - protein, 9 aa, synthetic construct
  source 1..9: note = Description of Artificial Sequence: Synthetic peptide; note = huAb13v1 vlCDR3
QQYNWYPFT

SEQ ID NO: 417 - protein, 119 aa, synthetic construct
  source 1..119: note = Description of Artificial Sequence: Synthetic polypeptide; note = TPP-5706 Variable heavy (vh) domain
QVQLQQPGAELVKPGASVKMSCKASGYTFTIYNVHWIKQTPGQGLEWMGTIFPGNGDTSYNQKFKDKATLTTDKSSKTAYMQLNSLTSEDSAVYYCARWDDGNVGFAHWGQGTLVTVSA

SEQ ID NO: 418 - protein, 5 aa, synthetic construct
  source 1..5: note = Description of Artificial Sequence: Synthetic peptide; note = TPP-5706 vhCDR1
IYNVH

SEQ ID NO: 419 - protein, 17 aa, synthetic construct
  source 1..17: note = Description of Artificial Sequence: Synthetic peptide; note = TPP-5706 vhCDR2
TIFPGNGDTSYNQKFKD

SEQ ID NO: 420 - protein, 10 aa, synthetic construct
  source 1..10: note = Description of Artificial Sequence: Synthetic peptide; note = TPP-5706 vhCDR3
WDDGNVGFAH

SEQ ID NO: 421 - protein, 107 aa, synthetic construct
  source 1..107: note = Description of Artificial Sequence: Synthetic polypeptide; note = TPP-5706 Variable light (vl) domain
DIQMTQSPASLSASVGETVTITCRASENINNYLTWFQQKQGKSPQLLVYHAKTLAEGVPSRFSGSGSGTQFSLKINSLQPEDFGSYYCQHHYGTPPTFGGGTKLEIK

SEQ ID NO: 422 - protein, 11 aa, synthetic construct
  source 1..11: note = Description of Artificial Sequence: Synthetic peptide; note = TPP-5706 vlCDR1
RASENINNYLT

SEQ ID NO: 423 - protein, 7 aa, synthetic construct
  source 1..7: note = Description of Artificial Sequence: Synthetic peptide; note = TPP-5706 vlCDR2
HAKTLAE

SEQ ID NO: 424 - protein, 9 aa, synthetic construct
  source 1..9: note = Description of Artificial Sequence: Synthetic peptide; note = TPP-5706 vlCDR3
QHHYGTPPT

SEQ ID NO: 425 - protein, 119 aa, synthetic construct
  source 1..119: note = Description of Artificial Sequence: Synthetic polypeptide; note = TPP-6642 Variable heavy (vh) domain
EVQLVQSGAEVKKPGASVKVSCKASGYTFTIYNVHWVRQAPGQGLEWMGTIFPGNGDTSYNQKFKDKVTMTTDTSTSTAYMELSSLRSEDTAVYYCARWDDGNVGFAHWGQGTLVTVSS

SEQ ID NO: 426 - protein, 5 aa, synthetic construct
  source 1..5: note = Description of Artificial Sequence: Synthetic peptide; note = TPP-6642 vhCDR1
IYNVH

SEQ ID NO: 427 - protein, 17 aa, synthetic construct
  source 1..17: note = Description of Artificial Sequence: Synthetic peptide; note = TPP-6642 vhCDR2
TIFPGNGDTSYNQKFKD

SEQ ID NO: 428 - protein, 10 aa, synthetic construct
  source 1..10: note = Description of Artificial Sequence: Synthetic peptide; note = TPP-6642 vhCDR3
WDDGNVGFAH

SEQ ID NO: 429 - protein, 107 aa, synthetic construct
  source 1..107: note = Description of Artificial Sequence: Synthetic polypeptide; note = TPP-6642 Variable light (vl) domain
DIQMTQSPSSLSASVGDRVTITCRASENINNYLTWFQQKQGKSPQLLIYHAKTLAEGVPSRFSGSGSGTDFTLTISSLQPEDFATYYCQHHYGTPPTFGGGTKVEIK

SEQ ID NO: 430 - protein, 11 aa, synthetic construct
  source 1..11: note = Description of Artificial Sequence: Synthetic peptide; note = TPP-6642 vlCDR1
RASENINNYLT

SEQ ID NO: 431 - protein, 7 aa, synthetic construct
  source 1..7: note = Description of Artificial Sequence: Synthetic peptide; note = TPP-6642 vlCDR2
HAKTLAE

SEQ ID NO: 432 - protein, 9 aa, synthetic construct
  source 1..9: note = Description of Artificial Sequence: Synthetic peptide; note = TPP-6642 vlCDR3
QHHYGTPPT

SEQ ID NO: 433 - protein, 119 aa, synthetic construct
  source 1..119: note = Description of Artificial Sequence: Synthetic polypeptide; note = TPP-6850 Variable heavy (vh) domain
EVQLVQSGAEVKKPGASVKVSCKASGYTFTIYNVHWIRQAPGQGLEWMGTIFPGNGDTSYNQKFKDRATLTTDKSTKTAYMELRSLRSDDTAVYYCARWDDGNVGFAHWGQGTLVTVSS

SEQ ID NO: 434 - protein, 5 aa, synthetic construct
  source 1..5: note = Description of Artificial Sequence: Synthetic peptide; note = TPP-6850 vhCDR1
IYNVH

SEQ ID NO: 435 - protein, 17 aa, synthetic construct
  source 1..17: note = Description of Artificial Sequence: Synthetic peptide; note = TPP-6850 vhCDR2
TIFPGNGDTSYNQKFKD

SEQ ID NO: 436 - protein, 10 aa, synthetic construct
  source 1..10: note = Description of Artificial Sequence: Synthetic peptide; note = TPP-6850 vhCDR3
WDDGNVGFAH

SEQ ID NO: 437 - protein, 107 aa, synthetic construct
  source 1..107: note = Description of Artificial Sequence: Synthetic polypeptide; note = TPP-6850 Variable light (vl) domain
DIQMTQSPSSLSASVGDRVTITCRASENINNYLTWFQQKPGKAPKLLVYHAKTLAEGVPSRFSGSGSGTQFTLTISSLQPEDFATYYCQHHYGTPPTFGQGTKLEIK

SEQ ID NO: 438 - protein, 11 aa, synthetic construct
  source 1..11: note = Description of Artificial Sequence: Synthetic peptide; note = TPP-6850 vlCDR1
RASENINNYLT

SEQ ID NO: 439 - protein, 7 aa, synthetic construct
  source 1..7: note = Description of Artificial Sequence: Synthetic peptide; note = TPP-6850 vlCDR2
HAKTLAE

SEQ ID NO: 440 - protein, 9 aa, synthetic construct
  source 1..9: note = Description of Artificial Sequence: Synthetic peptide; note = TPP-6850 vlCDR3
QHHYGTPPT

SEQ ID NO: 441 - protein, 118 aa, synthetic construct
  source 1..118: note = Description of Artificial Sequence: Synthetic polypeptide; note = TPP-3803 Variable heavy (vh) domain
QVKLQQSGAELVKPGASVKLSCKASGYTFTNYDINWVRQRPEQGLEWIGWIFPGDGSTQYNEKFKGKATLTTDTSSSTAYMQLSRLTSEDSAVYFCARQTTATWFAYWGQGTTVTVSS

SEQ ID NO: 442 - protein, 5 aa, synthetic construct
  source 1..5: note = Description of Artificial Sequence: Synthetic peptide; note = TPP-3803 vhCDR1
NYDIN

SEQ ID NO: 443 - protein, 17 aa, synthetic construct
  source 1..17: note = Description of Artificial Sequence: Synthetic peptide; note = TPP-3803 vhCDR2
WIFPGDGSTQYNEKFKG

SEQ ID NO: 444 - protein, 9 aa, synthetic construct
  source 1..9: note = Description of Artificial Sequence: Synthetic peptide; note = TPP-3803 vhCDR3
QTTATWFAY

SEQ ID NO: 445 - protein, 107 aa, synthetic construct
  source 1..107: note = Description of Artificial Sequence: Synthetic polypeptide; note = TPP-3803 Variable light (vl) domain
DIELTQSPTTLSVTPGDRVSLSCRASQSISDYLHWYQQKSHESPRLLIKYASQSISGIPSRFSGSGSGSDFTLSINSVEPEDVGVYYCQNGHSFPLTFGAGTKLELK

SEQ ID NO: 446 - protein, 11 aa, synthetic construct
  source 1..11: note = Description of Artificial Sequence: Synthetic peptide; note = TPP-3803 vlCDR1
RASQSISDYLH

SEQ ID NO: 447 - protein, 7 aa, synthetic construct
  source 1..7: note = Description of Artificial Sequence: Synthetic peptide; note = TPP-3803 vlCDR2
YASQSIS

SEQ ID NO: 448 - protein, 9 aa, synthetic construct
  source 1..9: note = Description of Artificial Sequence: Synthetic peptide; note = TPP-3803 vlCDR3
QNGHSFPLT

SEQ ID NO: 449 - protein, 115 aa, synthetic construct
  source 1..115: note = Description of Artificial Sequence: Synthetic polypeptide; note = TRL4542 Variable heavy (vh) domain
QVQLVESGGDLVQPGESLRLSCAASGFIFSDAWMVWVRQAPGKGLEWVGRIKTNGDGGTTDLTEPVKGRFTISRDDSKNMVYLQMNNLRTEDTAIYYCTTAPGFWGQGTLVTVSS

SEQ ID NO: 450 - protein, 5 aa, synthetic construct
  source 1..5: note = Description of Artificial Sequence: Synthetic peptide; note = TRL4542 vhCDR1
DAWMV

SEQ ID NO: 451 - protein, 19 aa, synthetic construct
  source 1..19: note = Description of Artificial Sequence: Synthetic peptide; note = TRL4542 vhCDR2
RIKTNGDGGTTDLTEPVKG

SEQ ID NO: 452 - protein, 4 aa, synthetic construct
  source 1..4: note = Description of Artificial Sequence: Synthetic peptide; note = TRL4542 vhCDR3
APGF

SEQ ID NO: 453 - protein, 113 aa, synthetic construct
  source 1..113: note = Description of Artificial Sequence: Synthetic polypeptide; note = TRL4542 Variable light (vl) domain
DIEMTQSPDSLAVSLGERATINCKSSHNLLYKSNNKNYLAWSQQKPGQPPRLLIYWASTRDSGVPDRFSGSGSGTDFTLTISSLQAEDVAVYYCHQYYGTKWTFGQGTRVEIK

SEQ ID NO: 454 - protein, 17 aa, synthetic construct
  source 1..17: note = Description of Artificial Sequence: Synthetic peptide; note = TRL4542 vlCDR1
KSSHNLLYKSNNKNYLA

SEQ ID NO: 455 - protein, 7 aa, synthetic construct
  source 1..7: note = Description of Artificial Sequence: Synthetic peptide; note = TRL4542 vlCDR2
WASTRDS

SEQ ID NO: 456 - protein, 9 aa, synthetic construct
  source 1..9: note = Description of Artificial Sequence: Synthetic peptide; note = TRL4542 vlCDR3
HQYYGTKWT

SEQ ID NO: 457 - protein, 119 aa, synthetic construct
  source 1..119: note = Description of Artificial Sequence: Synthetic polypeptide; note = h1702 Variable heavy (vh) domain
QVQLVQSGGGVVQPGTSLRLSCAASGFIFSSSAMHWVRQAPGKGLEWVAVISYDGSNKYYVDSVKGRFTISRDNSKNTLYLQMNSLRAEDTAVYYCARSARLYASFDYWGQGALVTVSS

SEQ ID NO: 458 - protein, 5 aa, synthetic construct
  source 1..5: note = Description of Artificial Sequence: Synthetic peptide; note = h1702 vhCDR1
SSAMH

SEQ ID NO: 459 - protein, 17 aa, synthetic construct
  source 1..17: note = Description of Artificial Sequence: Synthetic peptide; note = h1702 vhCDR2
VISYDGSNKYYVDSVKG

SEQ ID NO: 460 - protein, 10 aa, synthetic construct
  source 1..10: note = Description of Artificial Sequence: Synthetic peptide; note = h1702 vhCDR3
SARLYASFDY

SEQ ID NO: 461 - protein, 110 aa, synthetic construct
  source 1..110: note = Description of Artificial Sequence: Synthetic polypeptide; note = h1702 Variable light (vl) domain
QTVVTQEPSFSVSPGGTVTLTCGLSSGSVSTSHYPSWYQQTPGQAPRMLIYNTNTRSSGVPDRFSGSILGNKAALTITGAQADDESDYYCAIHVDRDIWVFGGGTKLTVL

SEQ ID NO: 462 - protein, 14 aa, synthetic construct
  source 1..14: note = Description of Artificial Sequence: Synthetic peptide; note = h1702 vlCDR1
GLSSGSVSTSHYPS

SEQ ID NO: 463 - protein, 7 aa, synthetic construct
  source 1..7: note = Description of Artificial Sequence: Synthetic peptide; note = h1702 vlCDR2
NTNTRSS

SEQ ID NO: 464 - protein, 10 aa, synthetic construct
  source 1..10: note = Description of Artificial Sequence: Synthetic peptide; note = h1702 vlCDR3
AIHVDRDIWV

SEQ ID NO: 465 - protein, 119 aa, synthetic construct
  source 1..119: note = Description of Artificial Sequence: Synthetic polypeptide; note = h1703 Variable heavy (vh) domain
QVQLQESGGGLVQPGGSLRLSCAASGFTFSSYAMSWVRQAPGKGLEWVSAISGSGGSTYYADSVKGRYTISRDNSKNTLYLQMNSLRAEDTAVYYCAKGVGPVHALDVWGQGTTVTVSS

SEQ ID NO: 466 - protein, 5 aa, synthetic construct
  source 1..5: note = Description of Artificial Sequence: Synthetic peptide; note = h1703 vhCDR1
SYAMS

SEQ ID NO: 467 - protein, 17 aa, synthetic construct
  source 1..17: note = Description of Artificial Sequence: Synthetic peptide; note = h1703 vhCDR2
AISGSGGSTYYADSVKG

SEQ ID NO: 468 - protein, 10 aa, synthetic construct
  source 1..10: note = Description of Artificial Sequence: Synthetic peptide; note = h1703 vhCDR3
GVGPVHALDV

SEQ ID NO: 469 - protein, 108 aa, synthetic construct
  source 1..108: note = Description of Artificial Sequence: Synthetic polypeptide; note = h1703 Variable light (vl) domain
DIRLTQSPSSLSASVGDRVTITCRASQSISTYLNWYQQKPGKAPILLINAVSGLQSGVPSRFSGSGSGTHFTLTITSLQPEDFATYYCQQSYSTPMWTFGQGTKVEIK

SEQ ID NO: 470 - protein, 11 aa, synthetic construct
  source 1..11: note = Description of Artificial Sequence: Synthetic peptide; note = h1703 vlCDR1
RASQSISTYLN

SEQ ID NO: 471 - protein, 7 aa, synthetic construct
  source 1..7: note = Description of Artificial Sequence: Synthetic peptide; note = h1703 vlCDR2
AVSGLQS

SEQ ID NO: 472 - protein, 10 aa, synthetic construct
  source 1..10: note = Description of Artificial Sequence: Synthetic peptide; note = h1703 vlCDR3
QQSYSTPMWT

SEQ ID NO: 473 - protein, 118 aa, synthetic construct
  source 1..118: note = Description of Artificial Sequence: Synthetic polypeptide; note = huA3 Variable heavy (vh) domain
EVQLVESGGGLVKPGGSLRLSCAASGFTFSRYGMSWVRQAPGKGLEWVSAISSGGGSIYYPDTVKGRLTISRDNAKNTLYLQMNSLRAEDTAVYYCTRHYLLFEMDYWGQGTTVTVSS

SEQ ID NO: 474 - protein, 5 aa, synthetic construct
  source 1..5: note = Description of Artificial Sequence: Synthetic peptide; note = huA3 vhCDR1
RYGMS

SEQ ID NO: 475 - protein, 17 aa, synthetic construct
  source 1..17: note = Description of Artificial Sequence: Synthetic peptide; note = huA3 vhCDR2
AISSGGGSIYYPDTVKG

SEQ ID NO: 476 - protein, 9 aa, synthetic construct
  source 1..9: note = Description of Artificial Sequence: Synthetic peptide; note = huA3 vhCDR3
HYLLFEMDY

SEQ ID NO: 477 - protein, 106 aa, synthetic construct
  source 1..106: note = Description of Artificial Sequence: Synthetic polypeptide; note = huA3 Variable light (vl) domain
DIVLTQSPSFLSASVGDRVTITCKASQNVNTAVAWYQQKPGKAPKLLIFSASNRYTGVPSRFSGSGSGTDFTLTISSLQPEDVAAYFCQQYSSSLTFGGGTKLEIK

SEQ ID NO: 478 - protein, 11 aa, synthetic construct
  source 1..11: note = Description of Artificial Sequence: Synthetic peptide; note = huA3 vlCDR1
KASQNVNTAVA

SEQ ID NO: 479 - protein, 7 aa, synthetic construct
  source 1..7: note = Description of Artificial Sequence: Synthetic peptide; note = huA3 vlCDR2
SASNRYT

SEQ ID NO: 480 - protein, 8 aa, synthetic construct
  source 1..8: note = Description of Artificial Sequence: Synthetic peptide; note = huA3 vlCDR3
QQYSSSLT

SEQ ID NO: 481 - protein, 124 aa, synthetic construct
  source 1..124: note = Description of Artificial Sequence: Synthetic polypeptide; note = huA9 Variable heavy (vh) domain
QVQLVQSGAEVKKPGASVKVSCKASGYTFTDYAMHWVKQAPGQGLEWMGVISTYYGNTNYNQKFKGRVTMTVDKSISTAYMELSRLRSDDTAVYYCARPVTTMVPRGGYYFDYWGQGTTVTVSS

SEQ ID NO: 482 - protein, 5 aa, synthetic construct
  source 1..5: note = Description of Artificial Sequence: Synthetic peptide; note = huA9 vhCDR1
DYAMH

SEQ ID NO: 483 - protein, 17 aa, synthetic construct
  source 1..17: note = Description of Artificial Sequence: Synthetic peptide; note = huA9 vhCDR2
VISTYYGNTNYNQKFKG

SEQ ID NO: 484 - protein, 15 aa, synthetic construct
  source 1..15: note = Description of Artificial Sequence: Synthetic peptide; note = huA9 vhCDR3
PVTTMVPRGGYYFDY

SEQ ID NO: 485 - protein, 107 aa, synthetic construct
  source 1..107: note = Description of Artificial Sequence: Synthetic polypeptide; note = huA9 Variable light (vl) domain
DIQLTQSPSFLSASVGDRVTITCRASKSINKYLAWYQQKPGKAPKLLIYSGSTLQSGVPSRFSGSGSGTEFTLTISSLQPEDFATYYCQQHNEYPLTFGQGTKLEIK

SEQ ID NO: 486 - protein, 11 aa, synthetic construct
  source 1..11: note = Description of Artificial Sequence: Synthetic peptide; note = huA9 vlCDR1
RASKSINKYLA

SEQ ID NO: 487 - protein, 7 aa, synthetic construct
  source 1..7: note = Description of Artificial Sequence: Synthetic peptide; note = huA9 vlCDR2
SGSTLQS

SEQ ID NO: 488 - protein, 9 aa, synthetic construct
  source 1..9: note = Description of Artificial Sequence: Synthetic peptide; note = huA9 vlCDR3
QQHNEYPLT

SEQ ID NO: 489 - protein, 118 aa, synthetic construct
  source 1..118: note = Description of Artificial Sequence: Synthetic polypeptide; note = m1704 Variable heavy (vh) domain
EVQLVESGGGLVKSGGSLKLSCAASGFTFSRYGMSWVRQTPEKRLEWVAAISSNGGSIYYPDTVKGRLTISRDNAKNTLYLQMISLRSEDTALYFCTRHYLLFEMDYWGRGTSVTVSS

SEQ ID NO: 490 - protein, 5 aa, synthetic construct
  source 1..5: note = Description of Artificial Sequence: Synthetic peptide; note = m1704 vhCDR1
RYGMS

SEQ ID NO: 491 - protein, 17 aa, synthetic construct
  source 1..17: note = Description of Artificial Sequence: Synthetic peptide; note = m1704 vhCDR2
AISSNGGSIYYPDTVKG

SEQ ID NO: 492 - protein, 9 aa, synthetic construct
  source 1..9: note = Description of Artificial Sequence: Synthetic peptide; note = m1704 vhCDR3
HYLLFEMDY

SEQ ID NO: 493 - protein, 106 aa, synthetic construct
  source 1..106: note = Description of Artificial Sequence: Synthetic polypeptide; note = m1704 Variable light (vl) domain
DIVMTQSQEFMSTTVGDRVYITCKASQNVNTAVAWYQQKPGQSPKLLIFSASNRYTGVPDRFTGSGSGTDFTLTISNVQSEDLAAYFCQQYSSSLTFGAGTKLELK

SEQ ID NO: 494 - protein, 11 aa, synthetic construct
  source 1..11: note = Description of Artificial Sequence: Synthetic peptide; note = m1704 vlCDR1
KASQNVNTAVA

SEQ ID NO: 495 - protein, 7 aa, synthetic construct
  source 1..7: note = Description of Artificial Sequence: Synthetic peptide; note = m1704 vlCDR2
SASNRYT

SEQ ID NO: 496 - protein, 8 aa, synthetic construct
  source 1..8: note = Description of Artificial Sequence: Synthetic peptide; note = m1704 vlCDR3
QQYSSSLT

SEQ ID NO: 497 - protein, 119 aa, synthetic construct
  source 1..119: note = Description of Artificial Sequence: Synthetic polypeptide; note = 2E4A3.189[B7H3]_H1.1
QVQLVQSGAEVKKPGASVKVSCKASGYTFTNNYMHWVRQAPGQGLEWMGIISPSSGRTSYAQKFQGRVTMTRDTSTSTVYMELSSLRSEDTAVYYCARGGGSSPRLDYWGQGTLVTVSS

SEQ ID NO: 498 - protein, 119 aa, synthetic construct
  source 1..119: note = Description of Artificial Sequence: Synthetic polypeptide; note = 2E4A3.189[B7H3]_H1.2
QVQLVQSGAEVKKPGASVKVSCKASGYTFTDHYMHWVRQAPGQGLEWMGIISPSSGRTSYAQKFQGRVTMTRDTSTSTVYMELSSLRSEDTAVYYCARGGGSSPRLDYWGQGTLVTVSS

SEQ ID NO: 499 - protein, 119 aa, synthetic construct
  source 1..119: note = Description of Artificial Sequence: Synthetic polypeptide; note = 2E4A3.189[B7H3]_H1.3
QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSS

SEQ ID NO: 500 - protein, 119 aa, synthetic construct
  source 1..119: note = Description of Artificial Sequence: Synthetic polypeptide; note = 2E4A3.189[B7H3]_H1.4
QVQLVQSGAEVKKPGASVKVSCKASGYPFTNHYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 501 - protein, 119 aa, synthetic construct
  source 1..119: note = Description of Artificial Sequence: Synthetic polypeptide; note = 2E4A3.189[B7H3]_H1.5
QVQLVQSGAEVKKPGASVKVSCKASGYTFTDHYMHWVRQAPGQGLEWMGIISPSAGSTSYAQKFQGRVTMTRDTSTSTVYMELSSLRSEDTAVYYCARGGGSSPRLDYWGQGTLVTVSS

SEQ ID NO: 502 - protein, 119 aa, synthetic construct
  source 1..119: note = Description of Artificial Sequence: Synthetic polypeptide; note = 2E4A3.189[B7H3]_H1.6
QVQLVQSGAEVKKPGASVKVSCKASGYIFTDYYMHWVRQAPGQGLEWMGIISPSGGSTDYAQKFQGRVTMTRDTSTSTVYMELSSLRSEDTAVYYCARGGGSSPRLDYWGQGTLVTVSS

SEQ ID NO: 503 - protein, 119 aa, synthetic construct
  source 1..119: note = Description of Artificial Sequence: Synthetic polypeptide; note = 2E4A3.189[B7H3]_H1.7
QVQLVQSGAEVKKPGASVKVSCKASGYTFTQNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 504 - protein, 119 aa, synthetic construct
  source 1..119: note = Description of Artificial Sequence: Synthetic polypeptide; note = 2E4A3.189[B7H3]_H1.8
QVQLVQSGAEVKKPGASVKVSCKASGYTFTDNYMHWVRQAPGQGLEWMGIISPSAGSTNYAQKFQGRVTMTRDTSTSTVYMELSSLRSEDTAVYYCARGGGSSPRLDYWGQGTLVTVSS

SEQ ID NO: 505 - protein, 119 aa, synthetic construct
  source 1..119: note = Description of Artificial Sequence: Synthetic polypeptide; note = 2E4A3.189[B7H3]_H1.9
QVQLVQSGAEVKKPGASVKVSCKASGYTFTDNYMHWVRQAPGQGLEWMGIISPSAGSTIYAQKFQGRVTMTRDTSTSTVYMELSSLRSEDTAVYYCARGGGSSPRLDYWGQGTLVTVSS

SEQ ID NO: 506 - protein, 119 aa, synthetic construct
  source 1..119: note = Description of Artificial Sequence: Synthetic polypeptide; note = 2E4A3.189[B7H3]_H1.10
QVQLVQSGAEVKKPGASVKVSCKASGYTFTNHYMHWVRQAPGQGLEWMGIISPSVGSTSYAQKFQGRVTMTRDTSTSTVYMELSSLRSEDTAVYYCARGGGSSPRLDYWGQGTLVTVSS

SEQ ID NO: 507 - protein, 119 aa, synthetic construct
  source 1..119: note = Description of Artificial Sequence: Synthetic polypeptide; note = 2E4A3.189[B7H3]_H1.11
QVQLVQSGAEVKKPGASVKVSCKASGYTFIDFYMHWVRQAPGQGLEWMGIISPSGGSTDYAQKFQGRVTMTRDTSTSTVYMELSSLRSEDTAVYYCARGGGSSPRLDYWGQGTLVTVSS

SEQ ID NO: 508 - protein, 119 aa, synthetic construct
  source 1..119: note = Description of Artificial Sequence: Synthetic polypeptide; note = 2E4A3.189[B7H3]_H1.12
QVQLVQSGAEVKKPGASVKVSCKASGYTFTNHYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 509 - protein, 119 aa, synthetic construct
  source 1..119: note = Description of Artificial Sequence: Synthetic polypeptide; note = 2E4A3.189[B7H3]_H1.13
QVQLVQSGAEVKKPGASVKVSCKASGYPFTDHYMHWVRQAPGQGLEWMGIISPSAGSTSYAQKFQGRVTMTRDTSTSTVYMELSSLRSEDTAVYYCARGGGSSPRLDYWGQGTLVTVSS

SEQ ID NO: 510 - protein, 119 aa, synthetic construct
  source 1..119: note = Description of Artificial Sequence: Synthetic polypeptide; note = 2E4A3.189[B7H3]_H1.14
QVQLVQSGAEVKKPGASVKVSCKASGYTFTENYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 511 - protein, 119 aa, synthetic construct
  source 1..119: note = Description of Artificial Sequence: Synthetic polypeptide; note = 2E4A3.189[B7H3]_H1.15
QVQLVQSGAEVKKPGASVKVSCKASGYTFINHYMHWVRQAPGQGLEWMGIISPSAGSTNYAQKFQGRVTMTRDTSTSTVYMELSSLRSEDTAVYYCARGGGSSPRLDYWGQGTLVTVSS

SEQ ID NO: 512 - protein, 119 aa, synthetic construct
  source 1..119: note = Description of Artificial Sequence: Synthetic polypeptide; note = 2E4A3.189[B7H3]_H1.16
QVQLVQSGAEVKKPGASVKVSCKASGYTFTEFYMHWVRQAPGQGLEWMGIISPSGGSTDYAQKFQGRVTMTRDTSTSTVYMELSSLRSEDTAVYYCARGGGSSPRLDYWGQGTLVTVSS

SEQ ID NO: 513 - protein, 119 aa, synthetic construct
  source 1..119: note = Description of Artificial Sequence: Synthetic polypeptide; note = 2E4A3.189[B7H3]_H1.17
QVQLVQSGAEVKKPGASVKVSCKASGYTFTDNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 514 - protein, 119 aa, synthetic construct
  source 1..119: note = Description of Artificial Sequence: Synthetic polypeptide; note = 2E4A3.189[B7H3]_H1.18
QVQLVQSGAEVKKPGASVKVSCKASGYIFTNHYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 515 - protein, 119 aa, synthetic construct
  source 1..119: note = Description of Artificial Sequence: Synthetic polypeptide; note = 2E4A3.189[B7H3]_H1.19
QVQLVQSGAEVKKPGASVKVSCKASGYTFINNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 516 - protein, 119 aa, synthetic construct
  source 1..119: note = Description of Artificial Sequence: Synthetic polypeptide; note = 2E4A3.189[B7H3]_H1.20
QVQLVQSGAEVKKPGASVKVSCKASGYIFTNNYMHWVRQAPGQGLEWMGIISPSVGRTSYAQKFQGRVTMTRDTSTSTVYMELSSLRSEDTAVYYCARGGGSSPRLDYWGQGTLVTVSS

SEQ ID NO: 517 - protein, 119 aa, synthetic construct
  source 1..119: note = Description of Artificial Sequence: Synthetic polypeptide; note = 2E4A3.189[B7H3]_H1.21
QVQLVQSGAEVKKPGASVKVSCKASGYAFTDNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 518 - protein, 119 aa, synthetic construct
  source 1..119: note = Description of Artificial Sequence: Synthetic polypeptide; note = 2E4A3.189[B7H3]_H1.22
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSS

SEQ ID NO: 519 - protein, 119 aa, synthetic construct
  source 1..119: note = Description of Artificial Sequence: Synthetic polypeptide; note = 2E4A3.189[B7H3]_H1.23
QVQLVQSGAEVKKPGASVKVSCKASGYAFTNHYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 520 - protein, 119 aa, synthetic construct
  source 1..119: note = Description of Artificial Sequence: Synthetic polypeptide; note = 2E4A3.189[B7H3]_H1.24
QVQLVQSGAEVKKPGASVKVSCKASGYIFTDNYMHWVRQAPGQGLEWMGIISPSGGSTAYAQKFQGRVTMTRDTSTSTVYMELSSLRSEDTAVYYCARGGGSSPRLDYWGQGTLVTVSS

SEQ ID NO: 521 - protein, 119 aa, synthetic construct
  source 1..119: note = Description of Artificial Sequence: Synthetic polypeptide; note = 2E4A3.189[B7H3]_H1.25
QVQLVQSGAEVKKPGASVKVSCKASGYAFTDNYMHWVRQAPGQGLEWMGIISPSAGSTDYAQKFQGRVTMTRDTSTSTVYMELSSLRSEDTAVYYCARGGGSSPRLDYWGQGTLVTVSS

SEQ ID NO: 522 - protein, 119 aa, synthetic construct
  source 1..119: note = Description of Artificial Sequence: Synthetic polypeptide; note = 2E4A3.189[B7H3]_H1.26
QVQLVQSGAEVKKPGASVKVSCKASGYIFTNNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 523 - protein, 119 aa, synthetic construct
  source 1..119: note = Description of Artificial Sequence: Synthetic polypeptide; note = 2E4A3.189[B7H3]_H1.27
QVQLVQSGAEVKKPGASVKVSCKASGYAFTNNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 524 - protein, 119 aa, synthetic construct
  source 1..119: note = Description of Artificial Sequence: Synthetic polypeptide; note = 2E4A3.189[B7H3]_H1.28
QVQLVQSGAEVKKPGASVKVSCKASGYSFTDNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 525 - protein, 119 aa, synthetic construct
  source 1..119: note = Description of Artificial Sequence: Synthetic polypeptide; note = 2E4A3.189[B7H3]_H1.29
QVQLVQSGAEVKKPGASVKVSCKASGYAFTNHYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 526 - protein, 119 aa, synthetic construct
  source 1..119: note = Description of Artificial Sequence: Synthetic polypeptide; note = 2E4A3.189[B7H3]_H1.30
QVQLVQSGAEVKKPGASVKVSCKASGYTFTNNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 527 - protein, 119 aa, synthetic construct
  source 1..119: note = Description of Artificial Sequence: Synthetic polypeptide; note = 2E4A3.189[B7H3]_H1.31
QVQLVQSGAEVKKPGASVKVSCKASGYTFINNYMHWVRQAPGQGLEWMGIISPSGGSTAYAQKFQGRVTMTRDTSTSTVYMELSSLRSEDTAVYYCARGGGSSPRLDYWGQGTLVTVSS

SEQ ID NO: 528 - protein, 119 aa, synthetic construct
  source 1..119: note = Description of Artificial Sequence: Synthetic polypeptide; note = 2E4A3.189[B7H3]_H1.32
QVQLVQSGAEVKKPGASVKVSCKASGYSFTNNYMHWVRQAPGQGLEWMGIISPSTGRTSYAQKFQGRVTMTRDTSTSTVYMELSSLRSEDTAVYYCARGGGSSPRLDYWGQGTLVTVSS

SEQ ID NO: 529 - protein, 119 aa, synthetic construct
  source 1..119: note = Description of Artificial Sequence: Synthetic polypeptide; note = 2E4A3.189[B7H3]_H1.33
QVQLVQSGAEVKKPGASVKVSCKASGYTFTDNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 530 - protein, 119 aa, synthetic construct
  source 1..119: note = Description of Artificial Sequence: Synthetic polypeptide; note = 2E4A3.189[B7H3]_H1.34
QVQLVQSGAEVKKPGASVKVSCKASGYTFTDNYMHWVRQAPGQGLEWMGIISPSGGSTAYAQKFQGRVTMTRDTSTSTVYMELSSLRSEDTAVYYCARGGGSSPRLDYWGQGTLVTVSS

SEQ ID NO: 531 - protein, 119 aa, synthetic construct
  source 1..119: note = Description of Artificial Sequence: Synthetic polypeptide; note = 2E4A3.189[B7H3]_H1.35
QVQLVQSGAEVKKPGASVKVSCKASGYTFTDNYMHWVRQAPGQGLEWMGIISPSVGTTAYAQKFQGRVTMTRDTSTSTVYMELSSLRSEDTAVYYCARGGGSSPRLDYWGQGTLVTVSS

SEQ ID NO: 532 - protein, 119 aa, synthetic construct
  source 1..119: note = Description of Artificial Sequence: Synthetic polypeptide; note = 2E4A3.189[B7H3]_H1.36
QVQLVQSGAEVKKPGASVKVSCKASGYPFINHYMHWVRQAPGQGLEWMGIISPSSGRTAYAQKFQGRVTMTRDTSTSTVYMELSSLRSEDTAVYYCARGGGSSPRLDYWGQGTLVTVSS

SEQ ID NO: 533 - protein, 119 aa, synthetic construct
  source 1..119: note = Description of Artificial Sequence: Synthetic polypeptide; note = 2E4A3.189[B7H3]_H1.37
QVQLVQSGAEVKKPGASVKVSCKASGYTFTNHYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 534 - protein, 119 aa, synthetic construct
  source 1..119: note = Description of Artificial Sequence: Synthetic polypeptide; note = 2E4A3.189[B7H3]_H1.38
QVQLVQSGAEVKKPGASVKVSCKASGYSFTNHYMHWVRQAPGQGLEWMGIISPSVGRTSYAQKFQGRVTMTRDTSTSTVYMELSSLRSEDTAVYYCARGGGSSPRLDYWGQGTLVTVSS

SEQ ID NO: 535 - protein, 119 aa, synthetic construct
  source 1..119: note = Description of Artificial Sequence: Synthetic polypeptide; note = 2E4A3.189[B7H3]_H1.39
QVQLVQSGAEVKKPGASVKVSCKASGYTFINHYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 536 - protein, 119 aa, synthetic construct
  source 1..119: note = Description of Artificial Sequence: Synthetic polypeptide; note = 2E4A3.189[B7H3]_H1.40
QVQLVQSGAEVKKPGASVKVSCKASGYSFTDNYMHWVRQAPGQGLEWMGIISPSGGSTAYAQKFQGRFTMTRDTSTSTVYMELSSLRSEDTAVYYCARGGGSSPRLDYWGQGTLVTVSS

SEQ ID NO: 537 - protein, 119 aa, synthetic construct
  source 1..119: note = Description of Artificial Sequence: Synthetic polypeptide; note = 2E4A3.189[B7H3]_H1.41
QVQLVQSGAEVKKPGASVKVSCKASGYIFTDNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 538 - protein, 119 aa, synthetic construct
  source 1..119: note = Description of Artificial Sequence: Synthetic polypeptide; note = 2E4A3.189[B7H3]_H1.42
QVQLVQSGAEVKKPGASVKVSCKASGYTFIDNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 539 - protein, 119 aa, synthetic construct
  source 1..119: note = Description of Artificial Sequence: Synthetic polypeptide; note = 2E4A3.189[B7H3]_H1.43
QVQLVQSGAEVKKPGASVKVSCKASGYSFTDNYMHWVRQAPGQGLEWMGIISPSSGRTSYAQKFQGRVTMTRDTSTSTVYMELSSLRSEDTAVYYCARGGGSSPRLDYWGQGTLVTVSS

SEQ ID NO: 540 - protein, 119 aa, synthetic construct
  source 1..119: note = Description of Artificial Sequence: Synthetic polypeptide; note = 2E4A3.189[B7H3]_H1.44
QVQLVQSGAEVKKPGASVKVSCKASGYIFTNNYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 541 - protein, 119 aa, synthetic construct
  source 1..119: note = Description of Artificial Sequence: Synthetic polypeptide; note = 2E4A3.189[B7H3]_H1.45
QVQLVQSGAEVKKPGASVKVSCKASGYAFTDNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 542 - protein, 119 aa, synthetic construct
  source 1..119: note = Description of Artificial Sequence: Synthetic polypeptide; note = 2E4A3.189[B7H3]_H1.46
QVQLVQSGAEVKKPGASVKVSCKASGYSFTNNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 543 - protein, 119 aa, synthetic construct
  source 1..119: note = Description of Artificial Sequence: Synthetic polypeptide; note = 2E4A3.189[B7H3]_H1.47
QVQLVQSGAEVKKPGASVKVSCKASGYIFTDHYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 544 - protein, 119 aa, synthetic construct
  source 1..119: note = Description of Artificial Sequence: Synthetic polypeptide; note = 2E4A3.189[B7H3]_H1.48
QVQLVQSGAEVKKPGASVKVSCKASGYSFTDNYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 545 - protein, 119 aa, synthetic construct
  source 1..119: note = Description of Artificial Sequence: Synthetic polypeptide; note = 2E4A3.189[B7H3]_H1.49
QVQLVQSGAEVKKPGASVKVSCKASGYSFTDNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 546 - protein, 119 aa, synthetic construct
  source 1..119: note = Description of Artificial Sequence: Synthetic polypeptide; note = 2E4A3.189[B7H3]_H1.50
QVQLVQSGAEVKKPGASVKVSCKASGYSFTNNYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 547 - protein, 119 aa, synthetic construct
  source 1..119: note = Description of Artificial Sequence: Synthetic polypeptide; note = 2E4A3.189[B7H3]_H1.51
QVQLVQSGAEVKKPGASVKVSCKASGYTFTDNYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 548 - protein, 119 aa, synthetic construct
  source 1..119: note = Description of Artificial Sequence: Synthetic polypeptide; note = 2E4A3.189[B7H3]_H1.52
QVQLVQSGAEVKKPGASVKVSCKASGYSFTDHYMHWVRQAPGQGLEWMGIISPSSGRTDYAQKFQGRVTMTRDTSTSTVYMELSSLRSEDTAVYYCARGGGSSPRLDYWGQGTLVTVSS

SEQ ID NO: 549 - protein, 119 aa, synthetic construct
  source 1..119: note = Description of Artificial Sequence: Synthetic polypeptide; note = 2E4A3.189[B7H3]_H1.53
QVQLVQSGAEVKKPGASVKVSCKASGYTFTNNYMHWVRQAPGQGLEWMGIISPSGGSTAYAQKFQGRVTMTRDTSTSTVYMELSSLRSEDTAVYYCARGGGSSPRLDYWGQGTLVTVSS

SEQ ID NO: 550 - protein, 119 aa, synthetic construct
  source 1..119: note = Description of Artificial Sequence: Synthetic polypeptide; note = 2E4A3.189[B7H3]_H1.54
QVQLVQSGAEVKKPGASVKVSCKASGYTFIDNYMHWVRQAPGQGLEWMGIISPSAGSTAYAQKFQGRVTMTRDTSTSTVYMELSSLRSEDTAVYYCARGGGSSPRLDYWGQGTLVTVSS

SEQ ID NO: 551 - protein, 119 aa, synthetic construct
  source 1..119: note = Description of Artificial Sequence: Synthetic polypeptide; note = 2E4A3.189[B7H3]_H1.55
QVQLVQSGAEVKKPGASVKVSCKASGYIFTDNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 552 - protein, 119 aa, synthetic construct
  source 1..119: note = Description of Artificial Sequence: Synthetic polypeptide; note = 2E4A3.189[B7H3]_H1.56
QVQLVQSGAEVKKPGASVKVSCKASGYTFTNNYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 553 - protein, 119 aa, synthetic construct
  source 1..119: note = Description of Artificial Sequence: Synthetic polypeptide; note = 2E4A3.189[B7H3]_H1.57
QVQLVQSGAEVKKPGASVKVSCKASGYIFTNHYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 554 - protein, 119 aa, synthetic construct
  source 1..119: note = Description of Artificial Sequence: Synthetic polypeptide; note = 2E4A3.189[B7H3]_H1.58
QVQLVQSGAEVKKPGASVKVSCKASGYTFTNHYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 555 - protein, 119 aa, synthetic construct
  source 1..119: note = Description of Artificial Sequence: Synthetic polypeptide; note = 2E4A3.189[B7H3]_H1.59
QVQLVQSGAEVKKPGASVKVSCKASGYPFTNNYMHWVRQAPGQGLEWMGIISPSVGTTSYAQKFQGRVTMTRDTSTSTVYMELSSLRSEDTAVYYCARGGGSSPRLDYWGQGTLVTVSS

SEQ ID NO: 556 - protein, 119 aa, synthetic construct
  source 1..119: note = Description of Artificial Sequence: Synthetic polypeptide; note = 2E4A3.189[B7H3]_H1.60
QVQLVQSGAEVKKPGASVKVSCKASGYTFTDNYMHWVRQAPGQGLEWMGIISPSGGTTAYAQKFQGRVTMTRDTSTSTVYMELSSLRSEDTAVYYCARGGGSSPRLDYWGQGTLVTVSS

SEQ ID NO: 557 - protein, 119 aa, synthetic construct
  source 1..119: note = Description of Artificial Sequence: Synthetic polypeptide; note = 2E4A3.189[B7H3]_H1.61
QVQLVQSGAEVKKPGASVKVSCKASGYTFINNYMHWVRQAPGQGLEWMGIISPIAGSTDYAQKFQGRVTMTRDTSTSTVYMELSSLRSEDTAVYYCARGGGSSPRLDYWGQGTLVTVSS

SEQ ID NO: 558 - protein, 119 aa, synthetic construct
  source 1..119: note = Description of Artificial Sequence: Synthetic polypeptide; note = 2E4A3.189[B7H3]_H1.62
QVQLVQSGAEVKKPGASVKVSCKASGYAFTNNYMHWVRQAPGQGLEWMGIISPSVGRTAYAQKFQGRVTMTRDTSTSTVYMELSSLRSEDTAVYYCARGGGSSPRLDYWGQGTLVTVSS

SEQ ID NO: 559 - protein, 119 aa, synthetic construct
  source 1..119: note = Description of Artificial Sequence: Synthetic polypeptide; note = 2E4A3.189[B7H3]_H1.63
QVQLVQSGAEVKKPGASVKVSCKASGYIFTNNYMHWVRQAPGQGLEWMGIIAPSVGRTAYAQKFQGRVTMTRDTSTSTVYMELSSLRSEDTAVYYCARGGGSSPRLDYWGQGTLVTVSS

SEQ ID NO: 560 - protein, 119 aa, synthetic construct; identical to SEQ ID NO: 516
  source 1..119: note = Description of Artificial Sequence: Synthetic polypeptide; note = 2E4A3.189[B7H3]_H1.64

SEQ ID NO: 561 - protein, 119 aa, synthetic construct
  source 1..119: note = Description of Artificial Sequence: Synthetic polypeptide; note = 2E4A3.189[B7H3]_H1.65
QVQLVQSGAEVKKPGASVKVSCKASGYIFTNNYMHWVRQAPGQGLEWMGIISPVVGRTAYAQKFQGRVTMTRDTSTSTVYMELSSLRSEDTAVYYCARGGGSSPRLDYWGQGTLVTVSS

SEQ ID NO: 562 - protein, 119 aa, synthetic construct
  source 1..119: note = Description of Artificial Sequence: Synthetic polypeptide; note = 2E4A3.189[B7H3]_H1.66
QVQLVQSGAEVKKPGASVKVSCKASGYGFTNNYMHWVRQAPGQGLEWMGIISPLVGRTAYAQKFQGRVTMTRDTSTSTVYMELSSLRSEDTAVYYCARGGGSSPRLDYWGQGTLVTVSS

SEQ ID NO: 563 - protein, 119 aa, synthetic construct
  source 1..119: note = Description of Artificial Sequence: Synthetic polypeptide; note = 2E4A3.189[B7H3]_H1.67
QVQLVQSGAEVKKPGASVKVSCKASGYIFTNNYMHWVRQAPGQGLEWMGIISPLVGRTAYAQKFQGRVTMTRDTSTSTVYMELSSLRSEDTAVYYCARGGGSSPRLDYWGQGTLVTVSS

SEQ ID NO: 564 - protein, 119 aa, synthetic construct
  source 1..119: note = Description of Artificial Sequence: Synthetic polypeptide; note = 2E4A3.189[B7H3]_H1.68
QVQLVQSGAEVKKPGASVKVSCKASGYLFTNNYMHWVRQAPGQGLEWMGIISPSVGRTAYAQKFQGRVTMTRDTSTSTVYMELSSLRSEDTAVYYCARGGGSSPRLDYWGQGTLVTVSS

SEQ ID NO: 565 - protein, 119 aa, synthetic construct
  source 1..119: note = Description of Artificial Sequence: Synthetic polypeptide; note = 2E4A3.189[B7H3]_H1.69
QVQLVQSGAEVKKPGASVKVSCKASGYIFTNNYMHWVRQAPGQGLEWMGIISPQVGRTAYAQKFQGRVTMTRDTSTSTVYMELSSLRSEDTAVYYCARGGGSSPRLDYWGQGTLVTVSS

SEQ ID NO: 566 - protein, 119 aa, synthetic construct
  source 1..119: note = Description of Artificial Sequence: Synthetic polypeptide; note = 2E4A3.189[B7H3]_H1.70
QVQLVQSGAEVKKPGASVKVSCKASGYFFTNNYMHWVRQAPGQGLEWMGIISPLVGRTAYAQKFQGRVTMTRDTSTSTVYMELSSLRSEDTAVYYCARGGGSSPRLDYWGQGTLVTVSS

SEQ ID NO: 567 - protein, 119 aa, synthetic construct
  source 1..119: note = Description of Artificial Sequence: Synthetic polypeptide; note = 2E4A3.189[B7H3]_H1.71
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRSDYWGQGTLVTVSS

SEQ ID NO: 568 - protein, 119 aa, synthetic construct
  source 1..119: note = Description of Artificial Sequence: Synthetic polypeptide; note = 2E4A3.189[B7H3]_H1.72
QVQLVQSGAEVKKPGASVKVSCKASGYIFVINYMHWVRQAPGQGLEWMGIISPAVGRTAYAQKFQGRVTMTRDTSTSTVYMELSSLRSEDTAVYYCARGGGSSPRLDYWGQGTLVTVSS

SEQ ID NO: 569 - protein, 119 aa, synthetic construct
  source 1..119: note = Description of Artificial Sequence: Synthetic polypeptide; note = 2E4A3.189[B7H3]_H1.73
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGFSSPRVDYWGQGTLVTVSS

SEQ ID NO: 570 - protein, 119 aa, synthetic construct
  source 1..119: note = Description of Artificial Sequence: Synthetic polypeptide; note = 2E4A3.189[B7H3]_H1.74
QVQLVQSGAEVKKPGASVKVSCKASGYSFKNNYMHWVRQAPGQGLEWMGIISPLVGRTAYAQKFQGRVTMTRDTSTSTVYMELSSLRSEDTAVYYCARGGGSSPRLDYWGQGTLVTVSS

SEQ ID NO: 571 - protein, 119 aa, synthetic construct
  source 1..119: note = Description of Artificial Sequence: Synthetic polypeptide; note = 2E4A3.189[B7H3]_H1.75
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRGDYWGQGTLVTVSS

SEQ ID NO: 572 - protein, 119 aa, synthetic construct
  source 1..119: note = Description of Artificial Sequence: Synthetic polypeptide; note = 2E4A3.189[B7H3]_H1.76
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRVDYWGQGTLVTVSS

SEQ ID NO: 573 - protein, 119 aa, synthetic construct
  source 1..119: note = Description of Artificial Sequence: Synthetic polypeptide; note = 2E4A3.189[B7H3]_H1.77
QVQLVQSGAEVKKPGASVKVSCKASGYGFTNNYMHWVRQAPGQGLEWMGIISPVVGRTAYAQKFQGRVTMTRDTSTSTVYMELSSLRSEDTAVYYCARGGGSSPRLDYWGQGTLVTVSS

SEQ ID NO: 574 - protein, 119 aa, synthetic construct
  source 1..119: note = Description of Artificial Sequence: Synthetic polypeptide; note = 2E4A3.189[B7H3]_H1.78
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARAGWSSPRLDYWGQGTLVTVSS

SEQ ID NO: 575 - protein, 119 aa, synthetic construct
  source 1..119: note = Description of Artificial Sequence: Synthetic polypeptide; note = 2E4A3.189[B7H3]_H1.79
QVQLVQSGAEVKKPGASVKVSCKASGYIFENNYMHWVRQAPGQGLEWMGIISPSVGRWAYAQKFQGRVTMTRDTSTSTVYMELSSLRSEDTAVYYCARGGGSSPRLDYWGQGTLVTVSS

SEQ ID NO: 576 - protein, 119 aa, synthetic construct
  source 1..119: note = Description of Artificial Sequence: Synthetic polypeptide; note = 2E4A3.189[B7H3]_H1.80
QVQLVQSGAEVKKPGASVKVSCKASGYIFTNVYMHWVRQAPGQGLEWMGIIFPGVGRTAYAQKFQGRVTMTRDTSTSTVYMELSSLRSEDTAVYYCARGGGSSPRLDYWGQGTLVTVSS

SEQ ID NO: 577 - protein, 119 aa, synthetic construct
  source 1..119: note = Description of Artificial Sequence: Synthetic polypeptide; note = 2E4A3.189[B7H3]_H1.81
QVQLVQSGAEVKKPGASVKVSCKASGYIFVFNYMHWVRQAPGQGLEWMGIISPSVGRTDYAQKFQGRVTMTRDTSTSTVYMELSSLRSEDTAVYYCARGGGSSPRLDYWGQGTLVTVSS

SEQ ID NO: 578 - protein, 119 aa, synthetic construct
  source 1..119: note = Description of Artificial Sequence: Synthetic polypeptide; note = 2E4A3.189[B7H3]_H1.82
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGLSSPRQDYWGQGTLVTVSS

SEQ ID NO: 579 - protein, 119 aa, synthetic construct
  source 1..119: note = Description of Artificial Sequence: Synthetic polypeptide; note = 2E4A3.189[B7H3]_H1.83
QVQLVQSGAEVKKPGASVKVSCKASGYIFVNNYMHWVRQAPGQGLEWMGIISPSVGRILYAQKFQGRVTMTRDTSTSTVYMELSSLRSEDTAVYYCARGGGSSPRLDYWGQGTLVTVSS

SEQ ID NO: 580 - protein, 119 aa, synthetic construct
  source 1..119: note = Description of Artificial Sequence: Synthetic polypeptide; note = 2E4A3.189[B7H3]_H1.84
QVQLVQSGAEVKKPGASVKVSCKASGYIFSNNYMHWVRQAPGQGLEWMGIISPSVGRTQYAQKFQGRVTMTRDTSTSTVYMELSSLRSEDTAVYYCARGGGSSPRLDYWGQGTLVTVSS

SEQ ID NO: 581 - protein, 119 aa, synthetic construct
  source 1..119: note = Description of Artificial Sequence: Synthetic polypeptide; note = 2E4A3.189[B7H3]_H1.85
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGMSSPRVDYWGQGTLVTVSS

SEQ ID NO: 582 - protein, 119 aa, synthetic construct
  source 1..119: note = Description of Artificial Sequence: Synthetic polypeptide; note = 2E4A3.189[B7H3]_H1.86
QVQLVQSGAEVKKPGASVKVSCKASGLGFTNNYMHWVRQAPGQGLEWMGILSPAVGRTAYAQKFQGRVTMTRDTSTSTVYMELSSLRSEDTAVYYCARGGGSSPRLDYWGQGTLVTVSS

SEQ ID NO: 583 - protein, 119 aa, synthetic construct
  source 1..119: note = Description of Artificial Sequence: Synthetic polypeptide; note = 2E4A3.189[B7H3]_H1.87
QVQLVQSGAEVKKPGASVKVSCKASGYIFTNNYMHWVRQAPGQGLEWMGIIGPAVGRTAYAQKFQGRVTMTRDTSTSTVYMELSSLRSEDTAVYYCARGGGSSPRLDYWGQGTLVTVSS

SEQ ID NO: 584 - protein, 119 aa, synthetic construct
  source 1..119: note = Description of Artificial Sequence: Synthetic polypeptide; note = 2E4A3.189[B7H3]_H1.88
QVQLVQSGAEVKKPGASVKVSCKASGYIFTNNYMHWVRQAPGQGLEWMGILSPVVGRTAYAQKFQGRVTMTRDTSTSTVYMELSSLRSEDTAVYYCARGGGSSPRLDYWGQGTLVTVSS

SEQ ID NO: 585 - protein, 121 aa, synthetic construct
  source 1..121: note = Description of Artificial Sequence: Synthetic polypeptide; note = 1A7[CD28]_H1.1
EVQLLESGGGLVQPGGSLRLSCAASGFTFSSYYMSWVRQAPGKGLEWVSTISGSGDSTYYADSVKGRFTISRDNSKNTLYLQMNSLRAEDTAVYYCAKSGPGLRQVGFDYWGQGTLVTVSS

SEQ ID NO: 586 - protein, 121 aa, synthetic construct
  source 1..121: note = Description of Artificial Sequence: Synthetic polypeptide; note = 1A7[CD28]_H1.2
EVQLLESGGGLVQPGGSLRLSCAASGFTFSSYAMSWVRQAPGKGLEWVSTIDGSGDSTYYADSVKGRFTISRDNSKNTLYLQMNSLRAEDTAVYYCAKSGPGLRQVGFDYWGQGTLVTVSS

SEQ ID NO: 587 - protein, 121 aa, synthetic construct
  source 1..121: note = Description of Artificial Sequence: Synthetic polypeptide; note = 1A7[CD28]_H1.3
EVQLLESGGGLVQPGGSLRLSCAASGFTFSSYAMSWVRQAPGKGLEWVSTIEGSGDSTYYADSVKGRFTISRDNSKNTLYLQMNSLRAEDTAVYYCAKSGPGLRQVGFDYWGQGTLVTVSS

SEQ ID NO: 588 - protein, 121 aa, synthetic construct
  source 1..121: note = Description of Artificial Sequence: Synthetic polypeptide; note = 1A7[CD28]_H1.4
EVQLLESGGGLVQPGGSLRLSCAASGFTFSSYAMSWVRQAPGKGLEWVSTIYGSGDSTYYADSVKGRFTISRDNSKNTLYLQMNSLRAEDTAVYYCAKSGPGLRQVGFDYWGQGTLVTVSS

SEQ ID NO: 589 - protein, 121 aa, synthetic construct
  source 1..121: note = Description of Artificial Sequence: Synthetic polypeptide; note = 1A7[CD28]_H1.5
EVQLLESGGGLVQPGGSLRLSCAASGFTFSSYAMSWVRQAPGKGLEWVSTISDSGDSTYYADSVKGRFTISRDNSKNTLYLQMNSLRAEDTAVYYCAKSGPGLRQVGFDYWGQGTLVTVSS

SEQ ID NO: 590 - protein, 121 aa, synthetic construct
  source 1..121: note = Description of Artificial Sequence: Synthetic polypeptide; note = 1A7[CD28]_H1.6
EVQLLESGGGLVQPGGSLRLSCAASGFTFSSYAMSWVRQAPGKGLEWVSTISESGDSTYYADSVKGRFTISRDNSKNTLYLQMNSLRAEDTAVYYCAKSGPGLRQVGFDYWGQGTLVTVSS

SEQ ID NO: 591 - protein, 121 aa, synthetic construct
  source 1..121: note = Description of Artificial Sequence: Synthetic polypeptide; note = 1A7[CD28]_H1.7
EVQLLESGGGLVQPGGSLRLSCAASGFTFSSYAMSWVRQAPGKGLEWVSTISGSGTSTYYADSVKGRFTISRDNSKNTLYLQMNSLRAEDTAVYYCAKSGPGLRQVGFDYWGQGTLVTVSS

SEQ ID NO: 592 - protein, 121 aa, synthetic construct
  source 1..121: note = Description of Artificial Sequence: Synthetic polypeptide; note = 1A7[CD28]_H1.8
EVQLLESGGGLVQPGGSLRLSCAASGFTFSSYAMSWVRQAPGKGLEWVSTISGSGYSTYYADSVKGRFTISRDNSKNTLYLQMNSLRAEDTAVYYCAKSGPGLRQVGFDYWGQGTLVTVSS

SEQ ID NO: 593 - protein, 121 aa, synthetic construct
  source 1..121: note = Description of Artificial Sequence: Synthetic polypeptide; note = 1A7[CD28]_H1.9
EVQLLESGGGLVQPGGSLRLSCAASGFTFSSYAMSWVRQAPGKGLEWVSTISGSGDYTYYADSVKGRFTISRDNSKNTLYLQMNSLRAEDTAVYYCAKSGPGLRQVGFDYWGQGTLVTVSS

SEQ ID NO: 594 - protein, 121 aa, synthetic construct
  source 1..121: note = Description of Artificial Sequence: Synthetic polypeptide; note = 1A7[CD28]_H1.10
EVQLLESGGGLVQPGGSLRLSCAASGFTFSSYYMSWVRQAPGKGLEWVSTIDGSGDSTYYADSVKGRFTISRDNSKNTLYLQMNSLRAEDTAVYYCAKSGPGLRQVGFDYWGQGTLVTVSS

SEQ ID NO: 595 - protein, 121 aa, synthetic construct
  source 1..121: note = Description of Artificial Sequence: Synthetic polypeptide; note = 1A7[CD28]_H1.11
EVQLLESGGGLVQPGGSLRLSCAASGFTFSSYYMSWVRQAPGKGLEWVSTIEGSGDSTYYADSVKGRFTISRDNSKNTLYLQMNSLRAEDTAVYYCAKSGPGLRQVGFDYWGQGTLVTVSS

SEQ ID NO: 596 - protein, 121 aa, synthetic construct
  source 1..121: note = Description of Artificial Sequence: Synthetic polypeptide; note = 1A7[CD28]_H1.12
EVQLLESGGGLVQPGGSLRLSCAASGFTFSSYYMSWVRQAPGKGLEWVSTIYGSGDSTYYADSVKGRFTISRDNSKNTLYLQMNSLRAEDTAVYYCAKSGPGLRQVGFDYWGQGTLVTVSS

SEQ ID NO: 597 - protein, 121 aa, synthetic construct
  source 1..121: note = Description of Artificial Sequence: Synthetic polypeptide; note = 1A7[CD28]_H1.13
EVQLLESGGGLVQPGGSLRLSCAASGFTFSSYYMSWVRQAPGKGLEWVSTISDSGDSTYYADSVKGRFTISRDNSKNTLYLQMNSLRAEDTAVYYCAKSGPGLRQVGFDYWGQGTLVTVSS

SEQ ID NO: 598 - protein, 121 aa, synthetic construct
  source 1..121: note = Description of Artificial Sequence: Synthetic polypeptide; note = 1A7[CD28]_H1.14
EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSS

SEQ ID NO: 599 - protein, 121 aa, synthetic construct
  source 1..121: note = Description of Artificial Sequence: Synthetic polypeptide; note = 1A7[CD28]_H1.15
EVQLLESGGGLVQPGGSLRLSCAASGFTFSSYYMSWVRQAPGKGLEWVSTISGSGTSTYYADSVKGRFTISRDNSKNTLYLQMNSLRAEDTAVYYCAKSGPGLRQVGFDYWGQGTLVTVSS

SEQ ID NO: 600 - protein, 121 aa, synthetic construct
  source 1..121: note = Description of Artificial Sequence: Synthetic polypeptide; note = 1A7[CD28]_H1.16
EVQLLESGGGLVQPGGSLRLSCAASGFTFSSYYMSWVRQAPGKGLEWVSTISGSGYSTYYADSVKGRFTISRDNSKNTLYLQMNSLRAEDTAVYYCAKSGPGLRQVGFDYWGQGTLVTVSS

SEQ ID NO: 601 - protein, 121 aa, synthetic construct
  source 1..121: note = Description of Artificial Sequence: Synthetic polypeptide; note = 1A7[CD28]_H1.17
EVQLLESGGGLVQPGGSLRLSCAASGFTFSSYYMSWVRQAPGKGLEWVSTISGSGDYTYYADSVKGRFTISRDNSKNTLYLQMNSLRAEDTAVYYCAKSGPGLRQVGFDYWGQGTLVTVSS

SEQ ID NO: 602 - protein, 121 aa, synthetic construct
  source 1..121: note = Description of Artificial Sequence: Synthetic polypeptide; note = 1A7[CD28]_H1.18
EVQLLESGGGLVQPGGSLRLSCAASGFTFSSYAMSWVRQAPGKGLEWVSTIDDSGDSTYYADSVKGRFTISRDNSKNTLYLQMNSLRAEDTAVYYCAKSGPGLRQVGFDYWGQGTLVTVSS

SEQ ID NO: 603 - protein, 121 aa, synthetic construct
  source 1..121: note = Description of Artificial Sequence: Synthetic polypeptide; note = 1A7[CD28]_H1.19
EVQLLESGGGLVQPGGSLRLSCAASGFTFSSYAMSWVRQAPGKGLEWVSTIDESGDSTYYADSVKGRFTISRDNSKNTLYLQMNSLRAEDTAVYYCAKSGPGLRQVGFDYWGQGTLVTVSS

SEQ ID NO: 604 - protein, 121 aa, synthetic construct
  source 1..121: note = Description of Artificial Sequence: Synthetic polypeptide; note = 1A7[CD28]_H1.20
EVQLLESGGGLVQPGGSLRLSCAASGFTFSSYAMSWVRQAPGKGLEWVSTIDGSGTSTYYADSVKGRFTISRDNSKNTLYLQMNSLRAEDTAVYYCAKSGPGLRQVGFDYWGQGTLVTVSS

SEQ ID NO: 605 - protein, 121 aa, synthetic construct
  source 1..121: note = Description of Artificial Sequence: Synthetic polypeptide; note = 1A7[CD28]_H1.21
EVQLLESGGGLVQPGGSLRLSCAASGFTFSSYAMSWVRQAPGKGLEWVSTIDGSGYSTYYADSVKGRFTISRDNSKNTLYLQMNSLRAEDTAVYYCAKSGPGLRQVGFDYWGQGTLVTVSS

SEQ ID NO: 606 - protein, 121 aa, synthetic construct
  source 1..121: note = Description of Artificial Sequence: Synthetic polypeptide; note = 1A7[CD28]_H1.22
EVQLLESGGGLVQPGGSLRLSCAASGFTFSSYAMSWVRQAPGKGLEWVSTIDGSGDYTYYADSVKGRFTISRDNSKNTLYLQMNSLRAEDTAVYYCAKSGPGLRQVGFDYWGQGTLVTVSS

SEQ ID NO: 607 - protein, 121 aa, synthetic construct
  source 1..121: note = Description of Artificial Sequence: Synthetic polypeptide; note = 1A7[CD28]_H1.23
EVQLLESGGGLVQPGGSLRLSCAASGFTFSSYAMSWVRQAPGKGLEWVSTIEDSGDSTYYADSVKGRFTISRDNSKNTLYLQMNSLRAEDTAVYYCAKSGPGLRQVGFDYWGQGTLVTVSS

SEQ ID NO: 608 - protein, 121 aa, synthetic construct
  source 1..121: note = Description of Artificial Sequence: Synthetic polypeptide; note = 1A7[CD28]_H1.24
EVQLLESGGGLVQPGGSLRLSCAASGFTFSSYAMSWVRQAPGKGLEWVSTIEESGDSTYYADSVKGRFTISRDNSKNTLYLQMNSLRAEDTAVYYCAKSGPGLRQVGFDYWGQGTLVTVSS

SEQ ID NO: 609 - protein, 121 aa, synthetic construct
  source 1..121: note = Description of Artificial Sequence: Synthetic polypeptide; note = 1A7[CD28]_H1.25
EVQLLESGGGLVQPGGSLRLSCAASGFTFSSYAMSWVRQAPGKGLEWVSTIEGSGTSTYYADSVKGRFTISRDNSKNTLYLQMNSLRAEDTAVYYCAKSGPGLRQVGFDYWGQGTLVTVSS

SEQ ID NO: 610 - protein, 121 aa, synthetic construct
  source 1..121: note = Description of Artificial Sequence: Synthetic polypeptide; note = 1A7[CD28]_H1.26
EVQLLESGGGLVQPGGSLRLSCAASGFTFSSYAMSWVRQAPGKGLEWVSTIEGSGYSTYYADSVKGRFTISRDNSKNTLYLQMNSLRAEDTAVYYCAKSGPGLRQVGFDYWGQGTLVTVSS

SEQ ID NO: 611 - protein, 121 aa, synthetic construct
  source 1..121: note = Description of Artificial Sequence: Synthetic polypeptide; note = 1A7[CD28]_H1.27
EVQLLESGGGLVQPGGSLRLSCAASGFTFSSYAMSWVRQAPGKGLEWVSTIEGSGDYTYYADSVKGRFTISRDNSKNTLYLQMNSLRAEDTAVYYCAKSGPGLRQVGFDYWGQGTLVTVSS

SEQ ID NO: 612 - protein, 121 aa, synthetic construct
  source 1..121: note = Description of Artificial Sequence: Synthetic polypeptide; note = 1A7[CD28]_H1.28
EVQLLESGGGLVQPGGSLRLSCAASGFTFSSYAMSWVRQAPGKGLEWVSTIYDSGDSTYYADSVKGRFTISRDNSKNTLYLQMNSLRAEDTAVYYCAKSGPGLRQVGFDYWGQGTLVTVSS

SEQ ID NO: 613 - protein, 121 aa, synthetic construct
  source 1..121: note = Description of Artificial Sequence: Synthetic polypeptide; note = 1A7[CD28]_H1.29
EVQLLESGGGLVQPGGSLRLSCAASGFTFSSYAMSWVRQAPGKGLEWVSTIYESGDSTYYADSVKGRFTISRDNSKNTLYLQMNSLRAEDTAVYYCAKSGPGLRQVGFDYWGQGTLVTVSS

SEQ ID NO: 614 - protein, 121 aa, synthetic construct
  source 1..121: note = Description of Artificial Sequence: Synthetic polypeptide; note = 1A7[CD28]_H1.30
EVQLLESGGGLVQPGGSLRLSCAASGFTFSSYAMSWVRQAPGKGLEWVSTIYGSGTSTYYADSVKGRFTISRDNSKNTLYLQMNSLRAEDTAVYYCAKSGPGLRQVGFDYWGQGTLVTVSS

SEQ ID NO: 615 - protein, 121 aa, synthetic construct
  source 1..121: note = Description of Artificial Sequence: Synthetic polypeptide; note = 1A7[CD28]_H1.31
EVQLLESGGGLVQPGGSLRLSCAASGFTFSSYAMSWVRQAPGKGLEWVSTIYGSGYSTYYADSVKGRFTISRDNSKNTLYLQMNSLRAEDTAVYYCAKSGPGLRQVGFDYWGQGTLVTVSS

SEQ ID NO: 616 - protein, 121 aa, synthetic construct
  source 1..121: note = Description of Artificial Sequence: Synthetic polypeptide; note = 1A7[CD28]_H1.32
EVQLLESGGGLVQPGGSLRLSCAASGFTFSSYAMSWVRQAPGKGLEWVSTIYGSGDYTYYADSVKGRFTISRDNSKNTLYLQMNSLRAEDTAVYYCAKSGPGLRQVGFDYWGQGTLVTVSS

SEQ ID NO: 617 - protein, 121 aa, synthetic construct
  source 1..121: note = Description of Artificial Sequence: Synthetic polypeptide; note = 1A7[CD28]_H1.33
EVQLLESGGGLVQPGGSLRLSCAASGFTFSSYAMSWVRQAPGKGLEWVSTISDSGTSTYYADSVKGRFTISRDNSKNTLYLQMNSLRAEDTAVYYCAKSGPGLRQVGFDYWGQGTLVTVSS

SEQ ID NO: 618 - protein, 121 aa, synthetic construct
  source 1..121: note = Description of Artificial Sequence: Synthetic polypeptide; note = 1A7[CD28]_H1.34
EVQLLESGGGLVQPGGSLRLSCAASGFTFSSYAMSWVRQAPGKGLEWVSTISDSGYSTYYADSVKGRFTISRDNSKNTLYLQMNSLRAEDTAVYYCAKSGPGLRQVGFDYWGQGTLVTVSS

SEQ ID NO: 619 - protein, 121 aa, synthetic construct
  source 1..121: note = Description of Artificial Sequence: Synthetic polypeptide; note = 1A7[CD28]_H1.35
EVQLLESGGGLVQPGGSLRLSCAASGFTFSSYAMSWVRQAPGKGLEWVSTISDSGDYTYYADSVKGRFTISRDNSKNTLYLQMNSLRAEDTAVYYCAKSGPGLRQVGFDYWGQGTLVTVSS

SEQ ID NO: 620 - protein, 121 aa, synthetic construct
  source 1..121: note = Description of Artificial Sequence: Synthetic polypeptide; note = 1A7[CD28]_H1.36
EVQLLESGGGLVQPGGSLRLSCAASGFTFSSYAMSWVRQAPGKGLEWVSTISESGTSTYYADSVKGRFTISRDNSKNTLYLQMNSLRAEDTAVYYCAKSGPGLRQVGFDYWGQGTLVTVSS

SEQ ID NO: 621 - protein, 121 aa, synthetic construct
  source 1..121: note = Description of Artificial Sequence: Synthetic polypeptide; note = 1A7[CD28]_H1.37
EVQLLESGGGLVQPGGSLRLSCAASGFTFSSYAMSWVRQAPGKGLEWVSTISESGYSTYYADSVKGRFTISRDNSKNTLYLQMNSLRAEDTAVYYCAKSGPGLRQVGFDYWGQGTLVTVSS

SEQ ID NO: 622 - protein, 121 aa, synthetic construct
  source 1..121: note = Description of Artificial Sequence: Synthetic polypeptide; note = 1A7[CD28]_H1.38
EVQLLESGGGLVQPGGSLRLSCAASGFTFSSYAMSWVRQAPGKGLEWVSTISESGDYTYYADSVKGRFTISRDNSKNTLYLQMNSLRAEDTAVYYCAKSGPGLRQVGFDYWGQGTLVTVSS

SEQ ID NO: 623 - protein, 121 aa, synthetic construct
  source 1..121: note = Description of Artificial Sequence: Synthetic polypeptide; note = 1A7[CD28]_H1.39
EVQLLESGGGLVQPGGSLRLSCAASGFTFSSYAMSWVRQAPGKGLEWVSTISGSGTYTYYADSVKGRFTISRDNSKNTLYLQMNSLRAEDTAVYYCAKSGPGLRQVGFDYWGQGTLVTVSS

SEQ ID NO: 624 - protein, 121 aa, synthetic construct
  source 1..121: note = Description of Artificial Sequence: Synthetic polypeptide; note = 1A7[CD28]_H1.40
EVQLLESGGGLVQPGGSLRLSCAASGFTFSSYAMSWVRQAPGKGLEWVSTISGSGYYTYYADSVKGRFTISRDNSKNTLYLQMNSLRAEDTAVYYCAKSGPGLRQVGFDYWGQGTLVTVSS

SEQ ID NO: 625 - protein, 121 aa, synthetic construct
  source 1..121: note = Description of Artificial Sequence: Synthetic polypeptide; note = 1A7[CD28]_H1.43
EVQLLESGGGLVQPGGSLRLSCAASGFSFSGNYMTWVRQAPGKGLEWVATITADSDATYYADSVKGRFTISRDNSKNTLYLQMNSLRAEDTAVYYCAKSGPGLRQVGFDYWGQGTLVTVSS

SEQ ID NO: 626 - protein, 121 aa, synthetic construct
  source 1..121: note = Description of Artificial Sequence: Synthetic polypeptide; note = 1A7[CD28]_H1.44
EVQLLESGGGLVQPGGSLRLSCAASGFTFSGYSMNWVRQAPGKGLEWVATIYANGSYTYYADSVKGRFTISRDNSKNTLYLQMNSLRAEDTAVYYCAKSGPGLRQVGFDYWGQGTLVTVSS

SEQ ID NO: 627 - protein, 121 aa, synthetic construct
  source 1..121: note = Description of Artificial Sequence: Synthetic polypeptide; note = 1A7[CD28]_H1.45
EVQLLESGGGLVQPGGSLRLSCAASGFNFEEYSMNWVRQAPGKGLEWVATITYNGDYTYYADSVKGRFTISRDNSKNTLYLQMNSLRAEDTAVYYCAKSGPGLRQVGFDYWGQGTLVTVSS

SEQ ID NO: 628 - protein, 121 aa, synthetic construct
  source 1..121: note = Description of Artificial Sequence: Synthetic polypeptide; note = 1A7[CD28]_H1.46
EVQLLESGGGLVQPGGSLRLSCAASGFSFRTYYMTWVRQAPGKGLEWVATITSDGDYTYYADSVKGRFTISRDNSKNTLYLQMNSLRAEDTAVYYCAKSGPGLRQVGFDYWGQGTLVTVSS

SEQ ID NO: 629 - protein, 121 aa, synthetic construct
  source 1..121: note = Description of Artificial Sequence: Synthetic polypeptide; note = 1A7[CD28]_H1.47
EVQLLESGGGLVQPGGSLRLSCAASGFSFKGYSMNWVRQAPGKGLEWVATIYASSDSTYYADSVKGRFTISRDNSKNTLYLQMNSLRAEDTAVYYCAKSGPGLRQVGFDYWGQGTLVTVSS

SEQ ID NO: 630 - protein, 121 aa, synthetic construct
  source 1..121: note = Description of Artificial Sequence: Synthetic polypeptide; note = 1A7[CD28]_H1.48
EVQLLESGGGLVQPGGSLRLSCAASGFSFGEYSMNWVRQAPGKGLEWVSTIYADGDYTYYADSVKGRFTISRDNSKNTLYLQMNSLRAEDTAVYYCAKSGPGLRQVGFDYWGQGTLVTVSS

SEQ ID NO: 631 - protein, 121 aa, synthetic construct
  source 1..121: note = Description of Artificial Sequence: Synthetic polypeptide; note = 1A7[CD28]_H1.49
EVQLLESGGGLVQPGGSLRLSCAASGFTFTDYSMNWVRQAPGKGLEWVATIYADSSSTYYADSVKGRFTISRDNSKNTLYLQMNSLRAEDTAVYYCAKSGPGLRQVGFDYWGQGTLVTVSS

SEQ ID NO: 632 - protein, 121 aa, synthetic construct
  source 1..121: note = Description of Artificial Sequence: Synthetic polypeptide; note = 1A7[CD28]_H1.50
EVQLLESGGGLVQPGGSLRLSCAASGFTFGGYSMNWVRQAPGKGLEWVATIYYDSTTTYYADSVKGRFTISRDNSKNTLYLQMNSLRAEDTAVYYCAKSGPGLRQVGFDYWGQGTLVTVSS

SEQ ID NO: 633 - protein, 121 aa, synthetic construct
  source 1..121: note = Description of Artificial Sequence: Synthetic polypeptide; note = 1A7[CD28]_H1.51
EVQLLESGGGLVQPGGSLRLSCAASGFTFGAYSMNWVRQAPGKGLEWVSTIYNDGATTYYADSVKGRFTISRDNSKNTLYLQMNSLRAEDTAVYYCAKSGPGLRQVGFDYWGQGTLVTVSS

SEQ ID NO: 634 - protein, 121 aa, synthetic construct
  source 1..121: note = Description of Artificial Sequence: Synthetic polypeptide; note = 1A7[CD28]_H1.52
EVQLLESGGGLVQPGGSLRLSCAASGFSFEAYSMNWVRQAPGKGLEWVATIYYDSSYTYYADSVKGRFTISRDNSKNTLYLQMNSLRAEDTAVYYCAKSGPGLRQVGFDYWGQGTLVTVSS

SEQ ID NO: 635 - protein, 121 aa, synthetic construct
  source 1..121: note = Description of Artificial Sequence: Synthetic polypeptide; note = 1A7[CD28]_H1.53
EVQLLESGGGLVQPGGSLRLSCAASGFSFGSYYMSWVRQAPGKGLEWVASIYYGGYDTYYADSVKGRFTISRDNSKNTLYLQMNSLRAEDTAVYYCAKSGPGLRQVGFDYWGQGTLVTVSS

SEQ ID NO: 636 - protein, 121 aa, synthetic construct
  source 1..121: note = Description of Artificial Sequence: Synthetic polypeptide; note = 1A7[CD28]_H1.54
EVQLLESGGGLVQPGGSLRLSCAASGFNFAEYSMSWVRQAPGKGLEWVATIYAGSDYTYYADSVKGRFTISRDNSKNTLYLQMNSLRAEDTAVYYCAKSGPGLRQVGFDYWGQGTLVTVSS

SEQ ID NO: 637 - protein, 121 aa, synthetic construct
  source 1..121: note = Description of Artificial Sequence: Synthetic polypeptide; note = 1A7[CD28]_H1.55
EVQLLESGGGLVQPGGSLRLSCAASGFTFGAYSINWVRQAPGKGLEWVATIYYDGSYTYYADSVKGRFTISRDNSKNTLYLQMNSLRAEDTAVYYCAKSGPGLRQVGFDYWGQGTLVTVSS

SEQ ID NO: 638 - protein, 121 aa, synthetic construct
  source 1..121: note = Description of Artificial Sequence: Synthetic polypeptide; note = 1A7[CD28]_H1.56
EVQLLESGGGLVQPGGSLRLSCAASGFTFSRYYINWVRQAPGKGLEWVASIYDGGADTYYADSVKGRFTISRDNSKNTLYLQMNSLRAEDTAVYYCAKSGPGLRQVGFDYWGQGTLVTVSS

SEQ ID NO: 639 - protein, 121 aa, synthetic construct
  source 1..121: note = Description of Artificial Sequence: Synthetic polypeptide; note = 1A7[CD28]_H1.57
EVQLLESGGGLVQPGGSLRLSCAASGFSFGTYSINWVRQAPGKGLEWVSTIYYDGASTYYADSVKGRFTISRDNSKNTLYLQMNSLRAEDTAVYYCAKSGPGLRQVGFDYWGQGTLVTVSS

SEQ ID NO: 640 - protein, 121 aa, synthetic construct
  source 1..121: note = Description of Artificial Sequence: Synthetic polypeptide; note = 1A7[CD28]_H1.58
EVQLLESGGGLVQPGGSLRLSCAASGFTFGKYSISWVRQAPGKGLEWVATIYNDGYYTYYADSVKGRFTISRDNSKNTLYLQMNSLRAEDTAVYYCAKSGPGLRQVGFDYWGQGTLVTVSS

SEQ ID NO: 641 - protein, 121 aa, synthetic construct
  source 1..121: note = Description of Artificial Sequence: Synthetic polypeptide; note = 1A7[CD28]_H1.59
EVQLLESGGGLVQPGGSLRLSCAASGFSFEKYYISWVRQAPGKGLEWVASIYDGSYDTYYADSVKGRFTISRDNSKNTLYLQMNSLRAEDTAVYYCAKSGPGLRQVGFDYWGQGTLVTVSS

SEQ ID NO: 642 - protein, 121 aa, synthetic construct
  source 1..121: note = Description of Artificial Sequence: Synthetic polypeptide; note = 1A7[CD28]_H1.60
EVQLLESGGGLVQPGGSLRLSCAASGFSFGTYSMNWVRQAPGKGLEWVATIDYDGSNTYYADSVKGRFTISRDNSKNTLYLQMNSLRAEDTAVYYCAKSGPGLRQVGFDYWGQGTLVTVSS

SEQ ID NO: 643 - protein, 121 aa, synthetic construct
  source 1..121: note = Description of Artificial Sequence: Synthetic polypeptide; note = 1A7[CD28]_H1.61
EVQLLESGGGLVQPGGSLRLSCAASGFSFAAYSMSWVRQAPGKGLEWVATIYAGSDYTYYADSVKGRFTISRDNSKNTLYLQMNSLRAEDTAVYYCAKSGPGLRQVGFDYWGQGTLVTVSS

SEQ ID NO: 644 - protein, 121 aa, synthetic construct
  source 1..121: note = Description of Artificial Sequence: Synthetic polypeptide; note = 1A7[CD28]_H1.62
EVQLLESGGGLVQPGGSLRLSCAASGFTFTTYSMTWVRQAPGKGLEWVATIYNDGYYTYYADSVKGRFTISRDNSKNTLYLQMNSLRAEDTAVYYCAKSGPGLRQVGFDYWGQGTLVTVSS

SEQ ID NO: 645 - protein, 121 aa, synthetic construct
  source 1..121: note = Description of Artificial Sequence: Synthetic polypeptide; note = 1A7[CD28]_H1.63
EVQLLESGGGLVQPGGSLRLSCAASGFSFKDYSMNWVRQAPGKGLEWVATIYYDGTYTYYADSVKGRFTISRDNSKNTLYLQMNSLRAEDTAVYYCAKSGPGLRQVGFDYWGQGTLVTVSS

SEQ ID NO: 646 - protein, 121 aa, synthetic construct
  source 1..121: note = Description of Artificial Sequence: Synthetic polypeptide; note = 1A7[CD28]_H1.64
EVQLLESGGGLVQPGGSLRLSCAASGFSFAAYSMNWVRQAPGKGLEWVATIYAGGAYTYYADSVKGRFTISRDNSKNTLYLQMNSLRAEDTAVYYCAKSGPGLRQVGFDYWGQGTLVTVSS

SEQ ID NO: 647 - protein, 121 aa, synthetic construct
  source 1..121: note = Description of Artificial Sequence: Synthetic polypeptide; note = 1A7[CD28]_H1.65
EVQLLESGGGLVQPGGSLRLSCAASGFNFAEYYISWVRQAPGKGLEWVASIYNGGSDTYYADSVKGRFTISRDNSKNTLYLQMNSLRAEDTAVYYCAKSGPGLRQVGFDYWGQGTLVTVSS

SEQ ID NO: 648 - protein, 121 aa, synthetic construct
  source 1..121: note = Description of Artificial Sequence: Synthetic polypeptide; note = 1A7[CD28]_H1.66
EVQLLESGGGLVQPGGSLRLSCAASGFSLGEYYMNWVRQAPGKGLEWVSTIDYDGTYTYYADSVKGRFTISRDNSKNTLYLQMNSLRAEDTAVYYCAKSGPGLRQVGFDYWGQGTLVTVSS

SEQ ID NO: 649 - protein, 121 aa, synthetic construct
  source 1..121: note = Description of Artificial Sequence: Synthetic polypeptide; note = 1A7[CD28]_H1.67
EVQLLESGGGLVQPGGSLRLSCAASGFTFNEYYITWVRQAPGKGLEWVSSIYSSSYDTYYADSVKGRFTISRDNSKNTLYLQMNSLRAEDTAVYYCAKSGPGLRQVGFDYWGQGTLVTVSS

SEQ ID NO: 650 - protein, 121 aa, synthetic construct
  source 1..121: note = Description of Artificial Sequence: Synthetic polypeptide; note = 1A7[CD28]_H1.68
EVQLLESGGGLVQPGGSLRLSCAASGFTFKDYYITWVRQAPGKGLEWVSSIYTSGYDTYYADSVKGRFTISRDNSKNTLYLQMNSLRAEDTAVYYCAKSGPGLRQVGFDYWGQGTLVTVSS

SEQ ID NO: 651 - protein, 121 aa, synthetic construct
  source 1..121: note = Description of Artificial Sequence: Synthetic polypeptide; note = 1A7[CD28]_H1.69
EVQLLESGGGLVQPGGSLRLSCAASGFSFGKYSINWVRQAPGKGLEWVATIYSDGTDTYYADSVKGRFTISRDNSKNTLYLQMNSLRAEDTAVYYCAKSGPGLRQVGFDYWGQGTLVTVSS

SEQ ID NO: 652 - protein, 107 aa, synthetic construct
  source 1..107: note = Description of Artificial Sequence: Synthetic polypeptide; note = 1A7[CD28]_L1.1
DIQMTQSPSSLSASVGDRVTITCRASQSISAYLNWYQQKPGKAPKLLIYAASSLQSGVPSRFSGSGSGTDFTLTISSLQPEDFATYYCQQSYSTPFTFGQGTKLEIK

SEQ ID NO: 653 - protein, 107 aa, synthetic construct
  source 1..107: note = Description of Artificial Sequence: Synthetic polypeptide; note = 1A7[CD28]_L1.2
DIQMTQSPSSLSASVGDRVTITCRASQSISDYLNWYQQKPGKAPKLLIYAASSLQSGVPSRFSGSGSGTDFTLTISSLQPEDFATYYCQQSYSTPFTFGQGTKLEIK

SEQ ID NO: 654 - protein, 107 aa, synthetic construct
  source 1..107: note = Description of Artificial Sequence: Synthetic polypeptide; note = 1A7[CD28]_L1.3
DIQMTQSPSSLSASVGDRVTITCRASQSISGYLNWYQQKPGKAPKLLIYAASSLQSGVPSRFSGSGSGTDFTLTISSLQPEDFATYYCQQSYSTPFTFGQGTKLEIK

SEQ ID NO: 655 - protein, 107 aa, synthetic construct
  source 1..107: note = Description of Artificial Sequence: Synthetic polypeptide; note = 1A7[CD28]_L1.4
DIQMTQSPSSLSASVGDRVTITCRASQSISHYLNWYQQKPGKAPKLLIYAASSLQSGVPSRFSGSGSGTDFTLTISSLQPEDFATYYCQQSYSTPFTFGQGTKLEIK

SEQ ID NO: 656 - protein, 107 aa, synthetic construct
  source 1..107: note = Description of Artificial Sequence: Synthetic polypeptide; note = 1A7[CD28]_L1.5
DIQMTQSPSSLSASVGDRVTITCRASQSISKYLNWYQQKPGKAPKLLIYAASSLQSGVPSRFSGSGSGTDFTLTISSLQPEDFATYYCQQSYSTPFTFGQGTKLEIK

SEQ ID NO: 657 - protein, 107 aa, synthetic construct
  source 1..107: note = Description of Artificial Sequence: Synthetic polypeptide; note = 1A7[CD28]_L1.6
DIQMTQSPSSLSASVGDRVTITCRASQSISNYLNWYQQKPGKAPKLLIYAASSLQSGVPSRFSGSGSGTDFTLTISSLQPEDFATYYCQQSYSTPFTFGQGTKLEIK

SEQ ID NO: 658 - protein, 107 aa, synthetic construct
  source 1..107: note = Description of Artificial Sequence: Synthetic polypeptide; note = 1A7[CD28]_L1.7
DIQMTQSPSSLSASVGDRVTITCRASQSISQYLNWYQQKPGKAPKLLIYAASSLQSGVPSRFSGSGSGTDFTLTISSLQPEDFATYYCQQSYSTPFTFGQGTKLEIK

SEQ ID NO: 659 - protein, 107 aa, synthetic construct
  source 1..107: note = Description of Artificial Sequence: Synthetic polypeptide; note = 1A7[CD28]_L1.8
DIQMTQSPSSLSASVGDRVTITCRASQSISTYLNWYQQKPGKAPKLLIYAASSLQSGVPSRFSGSGSGTDFTLTISSLQPEDFATYYCQQSYSTPFTFGQGTKLEIK

SEQ ID NO: 660 - protein, 107 aa, synthetic construct
  source 1..107: note = Description of Artificial Sequence: Synthetic polypeptide; note = 1A7[CD28]_L1.9
DIQMTQSPSSLSASVGDRVTITCRASQSISVYLNWYQQKPGKAPKLLIYAASSLQSGVPSRFSGSGSGTDFTLTISSLQPEDFATYYCQQSYSTPFTFGQGTKLEIK

SEQ ID NO: 661 - protein, 107 aa, synthetic construct
  source 1..107: note = Description of Artificial Sequence: Synthetic polypeptide; note = 1A7[CD28]_L1.10
DIQMTQSPSSLSASVGDRVTITCRASQSISYYLNWYQQKPGKAPKLLIYAASSLQSGVPSRFSGSGSGTDFTLTISSLQPEDFATYYCQQSYSTPFTFGQGTKLEIK

SEQ ID NO: 662 - protein, 107 aa, synthetic construct
  source 1..107: note = Description of Artificial Sequence: Synthetic polypeptide; note = 1A7[CD28]_L1.11
DIQMTQSPSSLSASVGDRVTITCRASQSISSALNWYQQKPGKAPKLLIYAASSLQSGVPSRFSGSGSGTDFTLTISSLQPEDFATYYCQQSYSTPFTFGQGTKLEIK

SEQ ID NO: 663 - protein, 107 aa, synthetic construct
  source 1..107: note = Description of Artificial Sequence: Synthetic polypeptide; note = 1A7[CD28]_L1.12
DIQMTQSPSSLSASVGDRVTITCRASQSISSDLNWYQQKPGKAPKLLIYAASSLQSGVPSRFSGSGSGTDFTLTISSLQPEDFATYYCQQSYSTPFTFGQGTKLEIK

SEQ ID NO: 664 - protein, 107 aa, synthetic construct
  source 1..107: note = Description of Artificial Sequence: Synthetic polypeptide; note = 1A7[CD28]_L1.13
DIQMTQSPSSLSASVGDRVTITCRASQSISSFLNWYQQKPGKAPKLLIYAASSLQSGVPSRFSGSGSGTDFTLTISSLQPEDFATYYCQQSYSTPFTFGQGTKLEIK

SEQ ID NO: 665 - protein, 107 aa, synthetic construct
  source 1..107: note = Description of Artificial Sequence: Synthetic polypeptide; note = 1A7[CD28]_L1.14
DIQMTQSPSSLSASVGDRVTITCRASQSISSHLNWYQQKPGKAPKLLIYAASSLQSGVPSRFSGSGSGTDFTLTISSLQPEDFATYYCQQSYSTPFTFGQGTKLEIK

SEQ ID NO: 666 - protein, 107 aa, synthetic construct
  source 1..107: note = Description of Artificial Sequence: Synthetic polypeptide; note = 1A7[CD28]_L1.15
DIQMTQSPSSLSASVGDRVTITCRASQSISSKLNWYQQKPGKAPKLLIYAASSLQSGVPSRFSGSGSGTDFTLTISSLQPEDFATYYCQQSYSTPFTFGQGTKLEIK

SEQ ID NO: 667 - protein, 107 aa, synthetic construct
  source 1..107: note = Description of Artificial Sequence: Synthetic polypeptide; note = 1A7[CD28]_L1.16
DIQMTQSPSSLSASVGDRVTITCRASQSISSLLNWYQQKPGKAPKLLIYAASSLQSGVPSRFSGSGSGTDFTLTISSLQPEDFATYYCQQSYSTPFTFGQGTKLEIK

SEQ ID NO: 668 - protein, 107 aa, synthetic construct
  source 1..107: note = Description of Artificial Sequence: Synthetic polypeptide; note = 1A7[CD28]_L1.17
DIQMTQSPSSLSASVGDRVTITCRASQSISSNLNWYQQKPGKAPKLLIYAASSLQSGVPSRFSGSGSGTDFTLTISSLQPEDFATYYCQQSYSTPFTFGQGTKLEIK

SEQ ID NO: 669 - protein, 107 aa, synthetic construct
  source 1..107: note = Description of Artificial Sequence: Synthetic polypeptide; note = 1A7[CD28]_L1.18
DIQMTQSPSSLSASVGDRVTITCRASQSISSQLNWYQQKPGKAPKLLIYAASSLQSGVPSRFSGSGSGTDFTLTISSLQPEDFATYYCQQSYSTPFTFGQGTKLEIK

SEQ ID NO: 670 - protein, 107 aa, synthetic construct
  source 1..107: note = Description of Artificial Sequence: Synthetic polypeptide; note = 1A7[CD28]_L1.19
DIQMTQSPSSLSASVGDRVTITCRASQSISSSLNWYQQKPGKAPKLLIYAASSLQSGVPSRFSGSGSGTDFTLTISSLQPEDFATYYCQQSYSTPFTFGQGTKLEIK

SEQ ID NO: 671 - protein, 107 aa, synthetic construct
  source 1..107: note = Description of Artificial Sequence: Synthetic polypeptide; note = 1A7[CD28]_L1.20
DIQMTQSPSSLSASVGDRVTITCRASQSISSWLNWYQQKPGKAPKLLIYAASSLQSGVPSRFSGSGSGTDFTLTISSLQPEDFATYYCQQSYSTPFTFGQGTKLEIK

SEQ ID NO: 672 - protein, 107 aa, synthetic construct
  source 1..107: note = Description of Artificial Sequence: Synthetic polypeptide; note = 1A7[CD28]_L1.21
DIQMTQSPSSLSASVGDRVTITCRASQSISSYLAWYQQKPGKAPKLLIYAASSLQSGVPSRFSGSGSGTDFTLTISSLQPEDFATYYCQQSYSTPFTFGQGTKLEIK

SEQ ID NO: 673 - protein, 107 aa, synthetic construct
  source 1..107: note = Description of Artificial Sequence: Synthetic polypeptide; note = 1A7[CD28]_L1.22
DIQMTQSPSSLSASVGDRVTITCRASQSISSYLDWYQQKPGKAPKLLIYAASSLQSGVPSRFSGSGSGTDFTLTISSLQPEDFATYYCQQSYSTPFTFGQGTKLEIK

SEQ ID NO: 674 - protein, 107 aa, synthetic construct
  source 1..107: note = Description of Artificial Sequence: Synthetic polypeptide; note = 1A7[CD28]_L1.23
DIQMTQSPSSLSASVGDRVTITCRASQSISSYLGWYQQKPGKAPKLLIYAASSLQSGVPSRFSGSGSGTDFTLTISSLQPEDFATYYCQQSYSTPFTFGQGTKLEIK

SEQ ID NO: 675 - protein, 107 aa, synthetic construct
  source 1..107: note = Description of Artificial Sequence: Synthetic polypeptide; note = 1A7[CD28]_L1.24
DIQMTQSPSSLSASVGDRVTITCRASQSISSYLHWYQQKPGKAPKLLIYAASSLQSGVPSRFSGSGSGTDFTLTISSLQPEDFATYYCQQSYSTPFTFGQGTKLEIK

SEQ ID NO: 676 - protein, 107 aa, synthetic construct
  source 1..107: note = Description of Artificial Sequence: Synthetic polypeptide; note = 1A7[CD28]_L1.25
DIQMTQSPSSLSASVGDRVTITCRASQSISSYLQWYQQKPGKAPKLLIYAASSLQSGVPSRFSGSGSGTDFTLTISSLQPEDFATYYCQQSYSTPFTFGQGTKLEIK

SEQ ID NO: 677 - protein, 107 aa, synthetic construct
  source 1..107: note = Description of Artificial Sequence: Synthetic polypeptide; note = 1A7[CD28]_L1.26
DIQMTQSPSSLSASVGDRVTITCRASQSISSYLSWYQQKPGKAPKLLIYAASSLQSGVPSRFSGSGSGTDFTLTISSLQPEDFATYYCQQSYSTPFTFGQGTKLEIK

SEQ ID NO: 678 - protein, 107 aa, synthetic construct
  source 1..107: note = Description of Artificial Sequence: Synthetic polypeptide; note = 1A7[CD28]_L1.27
DIQMTQSPSSLSASVGDRVTITCRASQSISSYLTWYQQKPGKAPKLLIYAASSLQSGVPSRFSGSGSGTDFTLTISSLQPEDFATYYCQQSYSTPFTFGQGTKLEIK

SEQ ID NO: 679 - protein, 107 aa, synthetic construct
  source 1..107: note = Description of Artificial Sequence: Synthetic polypeptide; note = 1A7[CD28]_L1.28
DIQMTQSPSSLSASVGDRVTITCRASQSISSYLYWYQQKPGKAPKLLIYAASSLQSGVPSRFSGSGSGTDFTLTISSLQPEDFATYYCQQSYSTPFTFGQGTKLEIK

SEQ ID NO: 680 - protein, 107 aa, synthetic construct
  source 1..107: note = Description of Artificial Sequence: Synthetic polypeptide; note = 1A7[CD28]_L1.29
DIQMTQSPSSLSASVGDRVTITCRASQSISSYLNWYQQKPGKAPKLLIYDASSLQSGVPSRFSGSGSGTDFTLTISSLQPEDFATYYCQQSYSTPFTFGQGTKLEIK

SEQ ID NO: 681 - protein, 107 aa, synthetic construct
  source 1..107: note = Description of Artificial Sequence: Synthetic polypeptide; note = 1A7[CD28]_L1.30
DIQMTQSPSSLSASVGDRVTITCRASQSISSYLNWYQQKPGKAPKLLIYGASSLQSGVPSRFSGSGSGTDFTLTISSLQPEDFATYYCQQSYSTPFTFGQGTKLEIK

SEQ ID NO: 682 - protein, 107 aa, synthetic construct
  source 1..107: note = Description of Artificial Sequence: Synthetic polypeptide; note = 1A7[CD28]_L1.31
DIQMTQSPSSLSASVGDRVTITCRASQSISSYLNWYQQKPGKAPKLLIYKASSLQSGVPSRFSGSGSGTDFTLTISSLQPEDFATYYCQQSYSTPFTFGQGTKLEIK

SEQ ID NO: 683 - protein, 107 aa, synthetic construct
  source 1..107: note = Description of Artificial Sequence: Synthetic polypeptide; note = 1A7[CD28]_L1.32
DIQMTQSPSSLSASVGDRVTITCRASQSISSYLNWYQQKPGKAPKLLIYLASSLQSGVPSRFSGSGSGTDFTLTISSLQPEDFATYYCQQSYSTPFTFGQGTKLEIK

SEQ ID NO: 684 - protein, 107 aa, synthetic construct
  source 1..107: note = Description of Artificial Sequence: Synthetic polypeptide; note = 1A7[CD28]_L1.33
DIQMTQSPSSLSASVGDRVTITCRASQSISSYLNWYQQKPGKAPKLLIYQASSLQSGVPSRFSGSGSGTDFTLTISSLQPEDFATYYCQQSYSTPFTFGQGTKLEIK

SEQ ID NO: 685 - protein, 107 aa, synthetic construct
  source 1..107: note = Description of Artificial Sequence: Synthetic polypeptide; note = 1A7[CD28]_L1.34
DIQMTQSPSSLSASVGDRVTITCRASQSISSYLNWYQQKPGKAPKLLIYSASSLQSGVPSRFSGSGSGTDFTLTISSLQPEDFATYYCQQSYSTPFTFGQGTKLEIK

SEQ ID NO: 686 - protein, 107 aa, synthetic construct
  source 1..107: note = Description of Artificial Sequence: Synthetic polypeptide; note = 1A7[CD28]_L1.35
DIQMTQSPSSLSASVGDRVTITCRASQSISSYLNWYQQKPGKAPKLLIYTASSLQSGVPSRFSGSGSGTDFTLTISSLQPEDFATYYCQQSYSTPFTFGQGTKLEIK

SEQ ID NO: 687 - protein, 107 aa, synthetic construct
  source 1..107: note = Description of Artificial Sequence: Synthetic polypeptide; note = 1A7[CD28]_L1.36
DIQMTQSPSSLSASVGDRVTITCRASQSISSYLNWYQQKPGKAPKLLIYWASSLQSGVPSRFSGSGSGTDFTLTISSLQPEDFATYYCQQSYSTPFTFGQGTKLEIK

SEQ ID NO: 688 - protein, 107 aa, synthetic construct
  source 1..107: note = Description of Artificial Sequence: Synthetic polypeptide; note = 1A7[CD28]_L1.37
DIQMTQSPSSLSASVGDRVTITCRASQSISSYLNWYQQKPGKAPKLLIYYASSLQSGVPSRFSGSGSGTDFTLTISSLQPEDFATYYCQQSYSTPFTFGQGTKLEIK

SEQ ID NO: 689 - protein, 107 aa, synthetic construct
  source 1..107: note = Description of Artificial Sequence: Synthetic polypeptide; note = 1A7[CD28]_L1.38
DIQMTQSPSSLSASVGDRVTITCRASQSISSYLNWYQQKPGKAPKLLIYAASALQSGVPSRFSGSGSGTDFTLTISSLQPEDFATYYCQQSYSTPFTFGQGTKLEIK

SEQ ID NO: 690 - protein, 107 aa, synthetic construct
  source 1..107: note = Description of Artificial Sequence: Synthetic polypeptide; note = 1A7[CD28]_L1.39
DIQMTQSPSSLSASVGDRVTITCRASQSISSYLNWYQQKPGKAPKLLIYAASDLQSGVPSRFSGSGSGTDFTLTISSLQPEDFATYYCQQSYSTPFTFGQGTKLEIK

SEQ ID NO: 691 - protein, 107 aa, synthetic construct
  source 1..107: note = Description of Artificial Sequence: Synthetic polypeptide; note = 1A7[CD28]_L1.40
DIQMTQSPSSLSASVGDRVTITCRASQSISSYLNWYQQKPGKAPKLLIYAASKLQSGVPSRFSGSGSGTDFTLTISSLQPEDFATYYCQQSYSTPFTFGQGTKLEIK

SEQ ID NO: 692 - protein, 107 aa, synthetic construct
  source 1..107: note = Description of Artificial Sequence: Synthetic polypeptide; note = 1A7[CD28]_L1.41
DIQMTQSPSSLSASVGDRVTITCRASQSISSYLNWYQQKPGKAPKLLIYAASNLQSGVPSRFSGSGSGTDFTLTISSLQPEDFATYYCQQSYSTPFTFGQGTKLEIK

SEQ ID NO: 693 - protein, 107 aa, synthetic construct
  source 1..107: note = Description of Artificial Sequence: Synthetic polypeptide; note = 1A7[CD28]_L1.42
DIQMTQSPSSLSASVGDRVTITCRASQSISSYLNWYQQKPGKAPKLLIYAASQLQSGVPSRFSGSGSGTDFTLTISSLQPEDFATYYCQQSYSTPFTFGQGTKLEIK

SEQ ID NO: 694 - protein, 107 aa, synthetic construct
  source 1..107: note = Description of Artificial Sequence: Synthetic polypeptide; note = 1A7[CD28]_L1.43
DIQMTQSPSSLSASVGDRVTITCRASQSISSYLNWYQQKPGKAPKLLIYAASTLQSGVPSRFSGSGSGTDFTLTISSLQPEDFATYYCQQSYSTPFTFGQGTKLEIK

SEQ ID NO: 695 - protein, 107 aa, synthetic construct
  source 1..107: note = Description of Artificial Sequence: Synthetic polypeptide; note = 1A7[CD28]_L1.44
DIQMTQSPSSLSASVGDRVTITCRASQSISSYLNWYQQKPGKAPKLLIYAASYLQSGVPSRFSGSGSGTDFTLTISSLQPEDFATYYCQQSYSTPFTFGQGTKLEIK

SEQ ID NO: 696 - protein, 107 aa, synthetic construct
  source 1..107: note = Description of Artificial Sequence: Synthetic polypeptide; note = 1A7[CD28]_L1.45
DIQMTQSPSSLSASVGDRVTITCRASQSISSYLNWYQQKPGKAPKLLIYAASSLASGVPSRFSGSGSGTDFTLTISSLQPEDFATYYCQQSYSTPFTFGQGTKLEIK

SEQ ID NO: 697 - protein, 107 aa, synthetic construct
  source 1..107: note = Description of Artificial Sequence: Synthetic polypeptide; note = 1A7[CD28]_L1.46
DIQMTQSPSSLSASVGDRVTITCRASQSISSYLNWYQQKPGKAPKLLIYAASSLESGVPSRFSGSGSGTDFTLTISSLQPEDFATYYCQQSYSTPFTFGQGTKLEIK

SEQ ID NO: 698 - protein, 107 aa, synthetic construct
  source 1..107: note = Description of Artificial Sequence: Synthetic polypeptide; note = 1A7[CD28]_L1.47
DIQMTQSPSSLSASVGDRVTITCRASQSISSYLNWYQQKPGKAPKLLIYAASSLFSGVPSRFSGSGSGTDFTLTISSLQPEDFATYYCQQSYSTPFTFGQGTKLEIK

SEQ ID NO: 699 - protein, 107 aa, synthetic construct
  source 1..107: note = Description of Artificial Sequence: Synthetic polypeptide; note = 1A7[CD28]_L1.48
DIQMTQSPSSLSASVGDRVTITCRASQSISSYLNWYQQKPGKAPKLLIYAASSLHSGVPSRFSGSGSGTDFTLTISSLQPEDFATYYCQQSYSTPFTFGQGTKLEIK

SEQ ID NO: 700 - protein, 107 aa, synthetic construct
  source 1..107: note = Description of Artificial Sequence: Synthetic polypeptide; note = 1A7[CD28]_L1.49
DIQMTQSPSSLSASVGDRVTITCRASQSISSYLNWYQQKPGKAPKLLIYAASSLISGVPSRFSGSGSGTDFTLTISSLQPEDFATYYCQQSYSTPFTFGQGTKLEIK

SEQ ID NO: 701 - protein, 107 aa, synthetic construct
  source 1..107: note = Description of Artificial Sequence: Synthetic polypeptide; note = 1A7[CD28]_L1.50
DIQMTQSPSSLSASVGDRVTITCRASQSISSYLNWYQQKPGKAPKLLIYAASSLKSGVPSRFSGSGSGTDFTLTISSLQPEDFATYYCQQSYSTPFTFGQGTKLEIK

SEQ ID NO: 702 - protein, 107 aa, synthetic construct
  source 1..107: note = Description of Artificial Sequence: Synthetic polypeptide; note = 1A7[CD28]_L1.51
DIQMTQSPSSLSASVGDRVTITCRASQSISSYLNWYQQKPGKAPKLLIYAASSLNSGVPSRFSGSGSGTDFTLTISSLQPEDFATYYCQQSYSTPFTFGQGTKLEIK

SEQ ID NO: 703 - protein, 107 aa, synthetic construct
  source 1..107: note = Description of Artificial Sequence: Synthetic polypeptide; note = 1A7[CD28]_L1.52
DIQMTQSPSSLSASVGDRVTITCRASQSISSYLNWYQQKPGKAPKLLIYAASSLSSGVPSRFSGSGSGTDFTLTISSLQPEDFATYYCQQSYSTPFTFGQGTKLEIK

SEQ ID NO: 704 - protein, 107 aa, synthetic construct
  source 1..107: note = Description of Artificial Sequence: Synthetic polypeptide; note = 1A7[CD28]_L1.53
DIQMTQSPSSLSASVGDRVTITCRASQSISSYLNWYQQKPGKAPKLLIYAASSLVSGVPSRFSGSGSGTDFTLTISSLQPEDFATYYCQQSYSTPFTFGQGTKLEIK

SEQ ID NO: 705 - protein, 107 aa, synthetic construct
  source 1..107: note = Description of Artificial Sequence: Synthetic polypeptide; note = 1A7[CD28]_L1.54
DIQMTQSPSSLSASVGDRVTITCRASQSISSYLNWYQQKPGKAPKLLIYAASSLYSGVPSRFSGSGSGTDFTLTISSLQPEDFATYYCQQSYSTPFTFGQGTKLEIK

SEQ ID NO: 706 - protein, 107 aa, synthetic construct
  source 1..107: note = Description of Artificial Sequence: Synthetic polypeptide; note = 1A7[CD28]_L1.55
DIQMTQSPSSLSASVGDRVTITCRASQSISSYLNWYQQKPGKAPKLLIYAASSLQAGVPSRFSGSGSGTDFTLTISSLQPEDFATYYCQQSYSTPFTFGQGTKLEIK

SEQ ID NO: 707 - protein, 107 aa, synthetic construct
  source 1..107: note = Description of Artificial Sequence: Synthetic polypeptide; note = 1A7[CD28]_L1.56
DIQMTQSPSSLSASVGDRVTITCRASQSISSYLNWYQQKPGKAPKLLIYAASSLQDGVPSRFSGSGSGTDFTLTISSLQPEDFATYYCQQSYSTPFTFGQGTKLEIK

SEQ ID NO: 708 - protein, 107 aa, synthetic construct
  source 1..107: note = Description of Artificial Sequence: Synthetic polypeptide; note = 1A7[CD28]_L1.57
DIQMTQSPSSLSASVGDRVTITCRASQSISSYLNWYQQKPGKAPKLLIYAASSLQGGVPSRFSGSGSGTDFTLTISSLQPEDFATYYCQQSYSTPFTFGQGTKLEIK

SEQ ID NO: 709 - protein, 107 aa, synthetic construct
  source 1..107: note = Description of Artificial Sequence: Synthetic polypeptide; note = 1A7[CD28]_L1.58
DIQMTQSPSSLSASVGDRVTITCRASQSISSYLNWYQQKPGKAPKLLIYAASSLQHGVPSRFSGSGSGTDFTLTISSLQPEDFATYYCQQSYSTPFTFGQGTKLEIK

SEQ ID NO: 710 - protein, 107 aa, synthetic construct
  source 1..107: note = Description of Artificial Sequence: Synthetic polypeptide; note = 1A7[CD28]_L1.59
DIQMTQSPSSLSASVGDRVTITCRASQSISSYLNWYQQKPGKAPKLLIYAASSLQKGVPSRFSGSGSGTDFTLTISSLQPEDFATYYCQQSYSTPFTFGQGTKLEIK

SEQ ID NO: 711 - protein, 107 aa, synthetic construct
  source 1..107: note = Description of Artificial Sequence: Synthetic polypeptide; note = 1A7[CD28]_L1.60
DIQMTQSPSSLSASVGDRVTITCRASQSISSYLNWYQQKPGKAPKLLIYAASSLQQGVPSRFSGSGSGTDFTLTISSLQPEDFATYYCQQSYSTPFTFGQGTKLEIK

SEQ ID NO: 712 - protein, 107 aa, synthetic construct
  source 1..107: note = Description of Artificial Sequence: Synthetic polypeptide; note = 1A7[CD28]_L1.61
DIQMTQSPSSLSASVGDRVTITCRASQSISSYLNWYQQKPGKAPKLLIYAASSLQTGVPSRFSGSGSGTDFTLTISSLQPEDFATYYCQQSYSTPFTFGQGTKLEIK

SEQ ID NO: 713 - protein, 107 aa, synthetic construct
  source 1..107: note = Description of Artificial Sequence: Synthetic polypeptide; note = 1A7[CD28]_L1.62
DIQMTQSPSSLSASVGDRVTITCRASQSISSYLNWYQQKPGKAPKLLIYAASSLQVGVPSRFSGSGSGTDFTLTISSLQPEDFATYYCQQSYSTPFTFGQGTKLEIK

SEQ ID NO: 714 - protein, 107 aa, synthetic construct
  source 1..107: note = Description of Artificial Sequence: Synthetic polypeptide; note = 1A7[CD28]_L1.63
DIQMTQSPSSLSASVGDRVTITCRASQSISSYLNWYQQKPGKAPKLLIYAASSLQYGVPSRFSGSGSGTDFTLTISSLQPEDFATYYCQQSYSTPFTFGQGTKLEIK

SEQ ID NO: 715 - protein, 107 aa, synthetic construct
  source 1..107: note = Description of Artificial Sequence: Synthetic polypeptide; note = 1A7[CD28]_L1.64
DIQMTQSPSSLSASVGDRVTITCRASQSISSYLNWYQQKPGKAPKLLIYAASSLQSGVPSRFSGSGSGTDFTLTISSLQPEDFATYYCQQAYSTPFTFGQGTKLEIK

SEQ ID NO: 716 - protein, 107 aa, synthetic construct
  source 1..107: note = Description of Artificial Sequence: Synthetic polypeptide; note = 1A7[CD28]_L1.65
DIQMTQSPSSLSASVGDRVTITCRASQSISSYLNWYQQKPGKAPKLLIYAASSLQSGVPSRFSGSGSGTDFTLTISSLQPEDFATYYCQQDYSTPFTFGQGTKLEIK

SEQ ID NO: 717 - protein, 107 aa, synthetic construct
  source 1..107: note = Description of Artificial Sequence: Synthetic polypeptide; note = 1A7[CD28]_L1.66
DIQMTQSPSSLSASVGDRVTITCRASQSISSYLNWYQQKPGKAPKLLIYAASSLQSGVPSRFSGSGSGTDFTLTISSLQPEDFATYYCQQFYSTPFTFGQGTKLEIK

SEQ ID NO: 718 - protein, 107 aa, synthetic construct
  source 1..107: note = Description of Artificial Sequence: Synthetic polypeptide; note = 1A7[CD28]_L1.67
DIQMTQSPSSLSASVGDRVTITCRASQSISSYLNWYQQKPGKAPKLLIYAASSLQSGVPSRFSGSGSGTDFTLTISSLQPEDFATYYCQQHYSTPFTFGQGTKLEIK

SEQ ID NO: 719 - protein, 107 aa, synthetic construct
  source 1..107: note = Description of Artificial Sequence: Synthetic polypeptide; note = 1A7[CD28]_L1.68
DIQMTQSPSSLSASVGDRVTITCRASQSISSYLNWYQQKPGKAPKLLIYAASSLQSGVPSRFSGSGSGTDFTLTISSLQPEDFATYYCQQKYSTPFTFGQGTKLEIK

SEQ ID NO: 720 - protein, 107 aa, synthetic construct
  source 1..107: note = Description of Artificial Sequence: Synthetic polypeptide; note = 1A7[CD28]_L1.69
DIQMTQSPSSLSASVGDRVTITCRASQSISSYLNWYQQKPGKAPKLLIYAASSLQSGVPSRFSGSGSGTDFTLTISSLQPEDFATYYCQQLYSTPFTFGQGTKLEIK

SEQ ID NO: 721 - protein, 107 aa, synthetic construct
  source 1..107: note = Description of Artificial Sequence: Synthetic polypeptide; note = 1A7[CD28]_L1.70
DIQMTQSPSSLSASVGDRVTITCRASQSISSYLNWYQQKPGKAPKLLIYAASSLQSGVPSRFSGSGSGTDFTLTISSLQPEDFATYYCQQTYSTPFTFGQGTKLEIK

SEQ ID NO: 722 - protein, 107 aa, synthetic construct
  source 1..107: note = Description of Artificial Sequence: Synthetic polypeptide; note = 1A7[CD28]_L1.71
DIQMTQSPSSLSASVGDRVTITCRASQSISSYLNWYQQKPGKAPKLLIYAASSLQSGVPSRFSGSGSGTDFTLTISSLQPEDFATYYCQQVYSTPFTFGQGTKLEIK

SEQ ID NO: 723 - protein, 107 aa, synthetic construct
  source 1..107: note = Description of Artificial Sequence: Synthetic polypeptide; note = 1A7[CD28]_L1.72
DIQMTQSPSSLSASVGDRVTITCRASQSISSYLNWYQQKPGKAPKLLIYAASSLQSGVPSRFSGSGSGTDFTLTISSLQPEDFATYYCQQYYSTPFTFGQGTKLEIK

SEQ ID NO: 724 - protein, 107 aa, synthetic construct
  source 1..107: note = Description of Artificial Sequence: Synthetic polypeptide; note = 1A7[CD28]_L1.73
DIQMTQSPSSLSASVGDRVTITCRASQSISSYLNWYQQKPGKAPKLLIYAASSLQSGVPSRFSGSGSGTDFTLTISSLQPEDFATYYCQQSASTPFTFGQGTKLEIK

SEQ ID NO: 725 - protein, 107 aa, synthetic construct
  source 1..107: note = Description of Artificial Sequence: Synthetic polypeptide; note = 1A7[CD28]_L1.74
DIQMTQSPSSLSASVGDRVTITCRASQSISSYLNWYQQKPGKAPKLLIYAASSLQSGVPSRFSGSGSGTDFTLTISSLQPEDFATYYCQQSDSTPFTFGQGTKLEIK

SEQ ID NO: 726 - protein, 107 aa, synthetic construct
  source 1..107: note = Description of Artificial Sequence: Synthetic polypeptide; note = 1A7[CD28]_L1.75
DIQMTQSPSSLSASVGDRVTITCRASQSISSYLNWYQQKPGKAPKLLIYAASSLQSGVPSRFSGSGSGTDFTLTISSLQPEDFATYYCQQSFSTPFTFGQGTKLEIK

SEQ ID NO: 727 - protein, 107 aa, synthetic construct
  source 1..107: note = Description of Artificial Sequence: Synthetic polypeptide; note = 1A7[CD28]_L1.76
DIQMTQSPSSLSASVGDRVTITCRASQSISSYLNWYQQKPGKAPKLLIYAASSLQSGVPSRFSGSGSGTDFTLTISSLQPEDFATYYCQQSHSTPFTFGQGTKLEIK

SEQ ID NO: 728 - protein, 107 aa, synthetic construct
  source 1..107: note = Description of Artificial Sequence: Synthetic polypeptide; note = 1A7[CD28]_L1.77
DIQMTQSPSSLSASVGDRVTITCRASQSISSYLNWYQQKPGKAPKLLIYAASSLQSGVPSRFSGSGSGTDFTLTISSLQPEDFATYYCQQSKSTPFTFGQGTKLEIK

SEQ ID NO: 729 - protein, 107 aa, synthetic construct
  source 1..107: note = Description of Artificial Sequence: Synthetic polypeptide; note = 1A7[CD28]_L1.78
DIQMTQSPSSLSASVGDRVTITCRASQSISSYLNWYQQKPGKAPKLLIYAASSLQSGVPSRFSGSGSGTDFTLTISSLQPEDFATYYCQQSLSTPFTFGQGTKLEIK

SEQ ID NO: 730 - protein, 107 aa, synthetic construct
  source 1..107: note = Description of Artificial Sequence: Synthetic polypeptide; note = 1A7[CD28]_L1.79
DIQMTQSPSSLSASVGDRVTITCRASQSISSYLNWYQQKPGKAPKLLIYAASSLQSGVPSRFSGSGSGTDFTLTISSLQPEDFATYYCQQSQSTPFTFGQGTKLEIK

SEQ ID NO: 731 - protein, 107 aa, synthetic construct
  source 1..107: note = Description of Artificial Sequence: Synthetic polypeptide; note = 1A7[CD28]_L1.80
DIQMTQSPSSLSASVGDRVTITCRASQSISSYLNWYQQKPGKAPKLLIYAASSLQSGVPSRFSGSGSGTDFTLTISSLQPEDFATYYCQQSVSTPFTFGQGTKLEIK

SEQ ID NO: 732 - protein, 107 aa, synthetic construct
  source 1..107: note = Description of Artificial Sequence: Synthetic polypeptide; note = 1A7[CD28]_L1.81
DIQMTQSPSSLSASVGDRVTITCRASQSISSYLNWYQQKPGKAPKLLIYAASSLQSGVPSRFSGSGSGTDFTLTISSLQPEDFATYYCQQSWSTPFTFGQGTKLEIK

SEQ ID NO: 733 - protein, 107 aa, synthetic construct
  source 1..107: note = Description of Artificial Sequence: Synthetic polypeptide; note = 1A7[CD28]_L1.82
DIQMTQSPSSLSASVGDRVTITCRASQSISSYLNWYQQKPGKAPKLLIYAASSLQSGVPSRFSGSGSGTDFTLTISSLQPEDFATYYCQQSYATPFTFGQGTKLEIK

SEQ ID NO: 734 - protein, 107 aa, synthetic construct
  source 1..107: note = Description of Artificial Sequence: Synthetic polypeptide; note = 1A7[CD28]_L1.83
DIQMTQSPSSLSASVGDRVTITCRASQSISSYLNWYQQKPGKAPKLLIYAASSLQSGVPSRFSGSGSGTDFTLTISSLQPEDFATYYCQQSYDTPFTFGQGTKLEIK

SEQ ID NO: 735 - protein, 107 aa, synthetic construct
  source 1..107: note = Description of Artificial Sequence: Synthetic polypeptide; note = 1A7[CD28]_L1.84
DIQMTQSPSSLSASVGDRVTITCRASQSISSYLNWYQQKPGKAPKLLIYAASSLQSGVPSRFSGSGSGTDFTLTISSLQPEDFATYYCQQSYGTPFTFGQGTKLEIK

SEQ ID NO: 736 - protein, 107 aa, synthetic construct
  source 1..107: note = Description of Artificial Sequence: Synthetic polypeptide; note = 1A7[CD28]_L1.85
DIQMTQSPSSLSASVGDRVTITCRASQSISSYLNWYQQKPGKAPKLLIYAASSLQSGVPSRFSGSGSGTDFTLTISSLQPEDFATYYCQQSYHTPFTFGQGTKLEIK

SEQ ID NO: 737 - protein, 107 aa, synthetic construct
  source 1..107: note = Description of Artificial Sequence: Synthetic polypeptide; note = 1A7[CD28]_L1.86
DIQMTQSPSSLSASVGDRVTITCRASQSISSYLNWYQQKPGKAPKLLIYAASSLQSGVPSRFSGSGSGTDFTLTISSLQPEDFATYYCQQSYKTPFTFGQGTKLEIK

SEQ ID NO: 738 - protein, 107 aa, synthetic construct
  source 1..107: note = Description of Artificial Sequence: Synthetic polypeptide; note = 1A7[CD28]_L1.87
DIQMTQSPSSLSASVGDRVTITCRASQSISSYLNWYQQKPGKAPKLLIYAASSLQSGVPSRFSGSGSGTDFTLTISSLQPEDFATYYCQQSYNTPFTFGQGTKLEIK

SEQ ID NO: 739 - protein, 107 aa, synthetic construct
  source 1..107: note = Description of Artificial Sequence: Synthetic polypeptide; note = 1A7[CD28]_L1.88
DIQMTQSPSSLSASVGDRVTITCRASQSISSYLNWYQQKPGKAPKLLIYAASSLQSGVPSRFSGSGSGTDFTLTISSLQPEDFATYYCQQSYQTPFTFGQGTKLEIK

SEQ ID NO: 740 - protein, 107 aa, synthetic construct
  source 1..107: note = Description of Artificial Sequence: Synthetic polypeptide; note = 1A7[CD28]_L1.89
DIQMTQSPSSLSASVGDRVTITCRASQSISSYLNWYQQKPGKAPKLLIYAASSLQSGVPSRFSGSGSGTDFTLTISSLQPEDFATYYCQQSYTTPFTFGQGTKLEIK

SEQ ID NO: 741 - protein, 107 aa, synthetic construct
  source 1..107: note = Description of Artificial Sequence: Synthetic polypeptide; note = 1A7[CD28]_L1.90
DIQMTQSPSSLSASVGDRVTITCRASQSISSYLNWYQQKPGKAPKLLIYAASSLQSGVPSRFSGSGSGTDFTLTISSLQPEDFATYYCQQSYVTPFTFGQGTKLEIK

SEQ ID NO: 742 - protein, 107 aa, synthetic construct
  source 1..107: note = Description of Artificial Sequence: Synthetic polypeptide; note = 1A7[CD28]_L1.91
DIQMTQSPSSLSASVGDRVTITCRASQSISSYLNWYQQKPGKAPKLLIYAASSLQSGVPSRFSGSGSGTDFTLTISSLQPEDFATYYCQQSYYTPFTFGQGTKLEIK

SEQ ID NO: 743 - protein, 107 aa, synthetic construct
  source 1..107: note = Description of Artificial Sequence: Synthetic polypeptide; note = 1A7[CD28]_L1.92
DIQMTQSPSSLSASVGDRVTITCRASQSISSYLNWYQQKPGKAPKLLIYAASSLQSGVPSRFSGSGSGTDFTLTISSLQPEDFATYYCQQSYSAPFTFGQGTKLEIK

SEQ ID NO: 744 - protein, 107 aa, synthetic construct
  source 1..107: note = Description of Artificial Sequence: Synthetic polypeptide; note = 1A7[CD28]_L1.93
DIQMTQSPSSLSASVGDRVTITCRASQSISSYLNWYQQKPGKAPKLLIYAASSLQSGVPSRFSGSGSGTDFTLTISSLQPEDFATYYCQQSYSDPFTFGQGTKLEIK

SEQ ID NO: 745 - protein, 107 aa, synthetic construct
  source 1..107: note = Description of Artificial Sequence: Synthetic polypeptide; note = 1A7[CD28]_L1.94
DIQMTQSPSSLSASVGDRVTITCRASQSISSYLNWYQQKPGKAPKLLIYAASSLQSGVPSRFSGSGSGTDFTLTISSLQPEDFATYYCQQSYSFPFTFGQGTKLEIK

SEQ ID NO: 746 - protein, 107 aa, synthetic construct
  source 1..107: note = Description of Artificial Sequence: Synthetic polypeptide; note = 1A7[CD28]_L1.95
DIQMTQSPSSLSASVGDRVTITCRASQSISSYLNWYQQKPGKAPKLLIYAASSLQSGVPSRFSGSGSGTDFTLTISSLQPEDFATYYCQQSYSIPFTFGQGTKLEIK

SEQ ID NO: 747 - protein, 107 aa, synthetic construct
  source 1..107: note = Description of Artificial Sequence: Synthetic polypeptide; note = 1A7[CD28]_L1.96
DIQMTQSPSSLSASVGDRVTITCRASQSISSYLNWYQQKPGKAPKLLIYAASSLQSGVPSRFSGSGSGTDFTLTISSLQPEDFATYYCQQSYSKPFTFGQGTKLEIK

SEQ ID NO: 748 - protein, 107 aa, synthetic construct
  source 1..107: note = Description of Artificial Sequence: Synthetic polypeptide; note = 1A7[CD28]_L1.97
DIQMTQSPSSLSASVGDRVTITCRASQSISSYLNWYQQKPGKAPKLLIYAASSLQSGVPSRFSGSGSGTDFTLTISSLQPEDFATYYCQQSYSLPFTFGQGTKLEIK

SEQ ID NO: 749 - protein, 107 aa, synthetic construct
  source 1..107: note = Description of Artificial Sequence: Synthetic polypeptide; note = 1A7[CD28]_L1.98
DIQMTQSPSSLSASVGDRVTITCRASQSISSYLNWYQQKPGKAPKLLIYAASSLQSGVPSRFSGSGSGTDFTLTISSLQPEDFATYYCQQSYSQPFTFGQGTKLEIK

SEQ ID NO: 750 - protein, 107 aa, synthetic construct
  source 1..107: note = Description of Artificial Sequence: Synthetic polypeptide; note = 1A7[CD28]_L1.99
DIQMTQSPSSLSASVGDRVTITCRASQSISSYLNWYQQKPGKAPKLLIYAASSLQSGVPSRFSGSGSGTDFTLTISSLQPEDFATYYCQQSYSSPFTFGQGTKLEIK

SEQ ID NO: 751 - protein, 107 aa, synthetic construct
  source 1..107: note = Description of Artificial Sequence: Synthetic polypeptide; note = 1A7[CD28]_L1.100
DIQMTQSPSSLSASVGDRVTITCRASQSISSYLNWYQQKPGKAPKLLIYAASSLQSGVPSRFSGSGSGTDFTLTISSLQPEDFATYYCQQSYSVPFTFGQGTKLEIK

SEQ ID NO: 752 - protein, 107 aa, synthetic construct
  source 1..107: note = Description of Artificial Sequence: Synthetic polypeptide; note = 1A7[CD28]_L1.101
DIQMTQSPSSLSASVGDRVTITCRASQSISSYLNWYQQKPGKAPKLLIYAASSLQSGVPSRFSGSGSGTDFTLTISSLQPEDFATYYCQQSYSYPFTFGQGTKLEIK

SEQ ID NO: 753 - protein, 107 aa, synthetic construct
  source 1..107: note = Description of Artificial Sequence: Synthetic polypeptide; note = 1A7[CD28]_L1.102
DIQMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTKLEIK

SEQ ID NO: 754 - protein, 107 aa, synthetic construct
  source 1..107: note = Description of Artificial Sequence: Synthetic polypeptide; note = 1A7[CD28]_L1.103
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKLEIK

SEQ ID NO: 755 - protein, 107 aa, synthetic construct
  source 1..107: note = Description of Artificial Sequence: Synthetic polypeptide; note = 1A7[CD28]_L1.104
DIQMTQSPSSLSASVGDRVTITCRASQSISSYLNWYQQKPGKAPKLLIYAASSLQSGVPSRFSGSGSGTDFTLTISSLQPEDFATYYCQQSYSTPWTFGQGTKLEIK

SEQ ID NO: 756 - protein, 107 aa, synthetic construct
  source 1..107: note = Description of Artificial Sequence: Synthetic polypeptide; note = 1A7[CD28]_L1.106
DIQMTQSPSSLSASVGDRVTITCRASQSISSYLTWYQQKPGKAPKLLIYAASSLQSGVPSRFSGSGSGTDFTLTISSLQPEDFATYYCQQSYNTPFTFGQGTKLEIK

SEQ ID NO: 757 - protein, 220 aa, Homo sapiens
  source 1..220: note = sp|P10747|CD28_HUMAN T-cell-specific surface glycoprotein CD28 OS=Homo sapiens OX=9606 GN=CD28 PE=1; SV = 1 Human CD28 sequence
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 758 - protein, 134 aa, Homo sapiens
  source 1..134: note = sp|P10747|19-152 Human CD28, extracellular domain
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 759 - protein, 218 aa, Mus musculus
  source 1..218: note = sp|P31041|CD28_MOUSE T-cell-specific surface glycoprotein CD28 OS=Mus musculus OX=10090 GN=Cd28 PE=1; SV = 2 Mouse CD28 sequence
MTLRLLFLALNFFSVQVTENKILVKQSPLLVVDSNEVSLSCRYSYNLLAKEFRASLYKGVNSDVEVCVGNGNFTYQPQFRSNAEFNCDGDFDNETVTFRLWNLHVNHTDIYFCKIEFMYPPPYLDNERSNGTIIHIKEKHLCHTQSSPKLFWALVVVAGVLFCYGLLVTVALCVIWTNSRRNRLLQSDYMNMTPRRPGLTRKPYQPYAPARDFAAYRP

SEQ ID NO: 760 - protein, 131 aa, Mus musculus
  source 1..131: note = sp|P31041|20-150 Mouse CD28, extracellular domain
NKILVKQSPLLVVDSNEVSLSCRYSYNLLAKEFRASLYKGVNSDVEVCVGNGNFTYQPQFRSNAEFNCDGDFDNETVTFRLWNLHVNHTDIYFCKIEFMYPPPYLDNERSNGTIIHIKEKHLCHTQSSPKL

SEQ ID NO: 761 - protein, 220 aa, Macaca fascicularis
  source 1..220: note = tr|Q0PDN3|Q0PDN3_MACFA CD28 OS=Macaca fascicularis; OX = 9541 GN=CD28 PE=2 SV=1 Cynomolgus CD28 sequence
MLRLLLALNLLPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWALVVVGGVLACYSLLVTVAFCIFWMRSKRSRLLHSDYMNMTPRRPGPTRKHYQPYAPPRDFAAYRS

SEQ ID NO: 762 - protein, 134 aa, Macaca fascicularis; identical to SEQ ID NO: 758
  source 1..134: note = tr|Q0PDN3|19-152 Cynomolgus CD28, extracellular domain

SEQ ID NO: 763 - protein, 534 aa, Homo sapiens
  source 1..534: note = sp|Q5ZPR3|CD276_HUMAN CD276 antigen OS=Homo sapiens; OX = 9606 GN=CD276 PE=1 SV=1 Human B7H3 sequence
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 764 - protein, 439 aa, Homo sapiens
  source 1..439: note = sp|Q5ZPR3|29-466 Human B7H3, extracellular domain
LEVQVPEDPVVALVGTDATSLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 765 - protein, 111 aa, Homo sapiens
  source 1..111: note = Human B7H3, V1C1 domain
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVA

SEQ ID NO: 766 - protein, 214 aa, Homo sapiens
  source 1..214: note = Human B7H3, V2C2 domain
PTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTIT

SEQ ID NO: 767 - protein, 316 aa, Mus musculus
  source 1..316: note = sp|Q8VE98|CD276_MOUSE CD276 antigen OS=Mus musculus; OX = 10090 GN=Cd276 PE=1 SV=1 Mouse B7H3 sequence
MLRGWGGPSVGVCVRTALGVLCLCLTGAVEVQVSEDPVVALVDTDATLRCSFSPEPGFSLAQLNLIWQLTDTKQLVHSFTEGRDQGSAYSNRTALFPDLLVQGNASLRLQRVRVTDEGSYTCFVSIQDFDSAAVSLQVAAPYSKPSMTLEPNKDLRPGNMVTITCSSYQGYPEAEVFWKDGQGVPLTGNVTTSQMANERGLFDVHSVLRVVLGANGTYSCLVRNPVLQQDAHGSVTITGQPLTFPPEALWVTVGLSVCLVVLLVALAFVCWRKIKQSCEEENAGAEDQDGDGEGSKTALRPLKPSENKEDDGQEIA

SEQ ID NO: 768 - protein, 220 aa, Mus musculus
  source 1..220: note = sp|Q8VE98|29-248 Mouse B7H3, extracellular domain
VEVQVSEDPVVALVDTDATLRCSFSPEPGFSLAQLNLIWQLTDTKQLVHSFTEGRDQGSAYSNRTALFPDLLVQGNASLRLQRVRVTDEGSYTCFVSIQDFDSAAVSLQVAAPYSKPSMTLEPNKDLRPGNMVTITCSSYQGYPEAEVFWKDGQGVPLTGNVTTSQMANERGLFDVHSVLRVVLGANGTYSCLVRNPVLQQDAHGSVTITGQPLTFPPEA

SEQ ID NO: 769 - protein, 584 aa, Macaca fascicularis
  source 1..584: note = XP_015308533.1 PREDICTED:  CD276 antigen isoform X1 [Macaca fascicularis] Cynomolgus CD28 sequence (predicted)
MKLSSDHVFPLFRKLQWLPAAFRIQFTPVSPSAGAAFHHGEPSCQLPHSKMLHRRGSPGMGVHVGAALGALWFCLTGALEVQVPEDPVVALVGTDATLRCSFSPEPGFSLAQLNLIWQLTDTKQLVHSFTEGRDQGSAYANRTALFLDLLAQGNASLRLQRVRVADEGSFTCFVSIRDFGSAAVSLQVAAPYSKPSMTLEPNKDLRPGDTVTITCSSYRGYPEAEVFWQDGQGAPLTGNVTTSQMANEQGLFDVHSVLRVVLGANGTYSCLVRNPVLQQDAHGSITITPQRSPTGAVEVQVPEDPVVALVGTDATLRCSFSPEPGFSLAQLNLIWQLTDTKQLVHSFTEGRDQGSAYANRTALFLDLLAQGNASLRLQRVRVADEGSFTCFVSIRDFGSAAVSLQVAAPYSKPSMTLEPNKDLRPGDTVTITCSSYRGYPEAEVFWQDGQGAPLTGNVTTSQMANEQGLFDVHSVLRVVLGANGTYSCLVRNPVLQQDAHGSVTITGQPMTFPPEALWVTVGLSVCLVALLVALAFVCWRKIKQSCEEENAGAEDQDGEGEGSKTALQPLKHSDSKEDDGQELA

SEQ ID NO: 770 - protein, 438 aa, Macaca fascicularis
  source 1..438: note = XP_015308533.1|79-516 Cynomolgus CD28, extracellular domain
LEVQVPEDPVVALVGTDATLRCSFSPEPGFSLAQLNLIWQLTDTKQLVHSFTEGRDQGSAYANRTALFLDLLAQGNASLRLQRVRVADEGSFTCFVSIRDFGSAAVSLQVAAPYSKPSMTLEPNKDLRPGDTVTITCSSYRGYPEAEVFWQDGQGAPLTGNVTTSQMANEQGLFDVHSVLRVVLGANGTYSCLVRNPVLQQDAHGSITITPQRSPTGAVEVQVPEDPVVALVGTDATLRCSFSPEPGFSLAQLNLIWQLTDTKQLVHSFTEGRDQGSAYANRTALFLDLLAQGNASLRLQRVRVADEGSFTCFVSIRDFGSAAVSLQVAAPYSKPSMTLEPNKDLRPGDTVTITCSSYRGYPEAEVFWQDGQGAPLTGNVTTSQMANEQGLFDVHSVLRVVLGANGTYSCLVRNPVLQQDAHGSVTITGQPMTFPPEA

SEQ ID NO: 771 - protein, 15 aa, synthetic construct
  source 1..15: note = Description of Artificial Sequence: Synthetic peptide
GGGGSGGGGSGGGGS

SEQ ID NO: 772 - protein, 18 aa, synthetic construct
  source 1..18: note = Description of Artificial Sequence: Synthetic peptide
GSTSGSGKPGSGEGSTKG

SEQ ID NO: 773 - protein, 14 aa, synthetic construct
  source 1..14: note = Description of Artificial Sequence: Synthetic peptide
IRPRAIGGSKPRVA

SEQ ID NO: 774 - protein, 15 aa, synthetic construct
  source 1..15: note = Description of Artificial Sequence: Synthetic peptide
GKGGSGKGGSGKGGS

SEQ ID NO: 775 - protein, 15 aa, synthetic construct
  source 1..15: note = Description of Artificial Sequence: Synthetic peptide
GGKGSGGKGSGGKGS

SEQ ID NO: 776 - protein, 15 aa, synthetic construct
  source 1..15: note = Description of Artificial Sequence: Synthetic peptide
GGGKSGGGKSGGGKS

SEQ ID NO: 777 - protein, 15 aa, synthetic construct
  source 1..15: note = Description of Artificial Sequence: Synthetic peptide
GKGKSGKGKSGKGKS

SEQ ID NO: 778 - protein, 15 aa, synthetic construct
  source 1..15: note = Description of Artificial Sequence: Synthetic peptide
GGGKSGGKGSGKGGS

SEQ ID NO: 779 - protein, 15 aa, synthetic construct
  source 1..15: note = Description of Artificial Sequence: Synthetic peptide
GKPGSGKPGSGKPGS

SEQ ID NO: 780 - protein, 20 aa, synthetic construct
  source 1..20: note = Description of Artificial Sequence: Synthetic peptide
GKPGSGKPGSGKPGSGKPGS

SEQ ID NO: 781 - protein, 20 aa, synthetic construct
  source 1..20: note = Description of Artificial Sequence: Synthetic peptide
GKGKSGKGKSGKGKSGKGKS

SEQ ID NO: 782 - protein, 20 aa, synthetic construct
  source 1..20: note = Description of Artificial Sequence: Synthetic peptide
GGGGSGGGGSGGGGSGGGGS

SEQ ID NO: 783 - protein, 14 aa, synthetic construct
  source 1..14: note = Description of Artificial Sequence: Synthetic peptide
STAGDTHLGGEDFD

SEQ ID NO: 784 - protein, 15 aa, synthetic construct
  source 1..15: note = Description of Artificial Sequence: Synthetic peptide
GEGGSGEGGSGEGGS

SEQ ID NO: 785 - protein, 15 aa, synthetic construct
  source 1..15: note = Description of Artificial Sequence: Synthetic peptide
GGEGSGGEGSGGEGS

SEQ ID NO: 786 - protein, 15 aa, synthetic construct
  source 1..15: note = Description of Artificial Sequence: Synthetic peptide
GGGESGGGESGGGES

SEQ ID NO: 787 - protein, 15 aa, synthetic construct
  source 1..15: note = Description of Artificial Sequence: Synthetic peptide
GEGESGEGESGEGES

SEQ ID NO: 788 - protein, 15 aa, synthetic construct
  source 1..15: note = Description of Artificial Sequence: Synthetic peptide
GGGESGGEGSGEGGS

SEQ ID NO: 789 - protein, 20 aa, synthetic construct
  source 1..20: note = Description of Artificial Sequence: Synthetic peptide
GEGESGEGESGEGESGEGES

SEQ ID NO: 790 - protein, 15 aa, synthetic construct
  source 1..15: note = Description of Artificial Sequence: Synthetic peptide
GGGGSGGGGSGGGGS

SEQ ID NO: 791 - protein, 20 aa, synthetic construct
  source 1..20: note = Description of Artificial Sequence: Synthetic peptide
GGGGSGGGGSGGGGSGGGGS

SEQ ID NO: 792 - protein, 18 aa, synthetic construct
  source 1..18: note = Description of Artificial Sequence: Synthetic peptide
GSTSGSGKPGSGEGSTKG

SEQ ID NO: 793 - protein, 19 aa, synthetic construct
  source 1..19: note = Description of Artificial Sequence: Synthetic peptide
PRGASKSGSASQTGSAPGS

SEQ ID NO: 794 - protein, 19 aa, synthetic construct
  source 1..19: note = Description of Artificial Sequence: Synthetic peptide
GTAAAGAGAAGGAAAGAAG

SEQ ID NO: 795 - protein, 19 aa, synthetic construct
  source 1..19: note = Description of Artificial Sequence: Synthetic peptide
GTSGSSGSGSGGSGSGGGG

SEQ ID NO: 796 - protein, 20 aa, synthetic construct
  source 1..20: note = Description of Artificial Sequence: Synthetic peptide
GKPGSGKPGSGKPGSGKPGS

SEQ ID NO: 797 - protein, 5 aa, synthetic construct
  source 1..5: note = Description of Artificial Sequence: Synthetic peptide
GGGGS

SEQ ID NO: 798 - protein, 10 aa, synthetic construct
  source 1..10: note = Description of Artificial Sequence: Synthetic peptide
GGGGSGGGGS

SEQ ID NO: 799 - protein, 15 aa, synthetic construct
  source 1..15: note = Description of Artificial Sequence: Synthetic peptide
GGGGSGGGGSGGGGS

SEQ ID NO: 800 - protein, 20 aa, synthetic construct
  source 1..20: note = Description of Artificial Sequence: Synthetic peptide
GGGGSGGGGSGGGGSGGGGS

SEQ ID NO: 801 - protein, 25 aa, synthetic construct
  source 1..25: note = Description of Artificial Sequence: Synthetic peptide
GGGGSGGGGSGGGGSGGGGSGGGGS

SEQ ID NO: 802 - protein, 30 aa, synthetic construct
  source 1..30: note = Description of Artificial Sequence: Synthetic polypeptide
GGGGSGGGGSGGGGSGGGGSGGGGSGGGGS

SEQ ID NO: 803 - protein, 35 aa, synthetic construct
  source 1..35: note = Description of Artificial Sequence: Synthetic polypeptide
GGGGSGGGGSGGGGSGGGGSGGGGSGGGGSGGGGS

SEQ ID NO: 804 - protein, 5 aa, synthetic construct
  source 1..5: note = Description of Artificial Sequence: Synthetic peptide
GGGGA

SEQ ID NO: 805 - protein, 10 aa, synthetic construct
  source 1..10: note = Description of Artificial Sequence: Synthetic peptide
GGGGAGGGGA

SEQ ID NO: 806 - protein, 15 aa, synthetic construct
  source 1..15: note = Description of Artificial Sequence: Synthetic peptide
GGGGAGGGGAGGGGA

SEQ ID NO: 807 - protein, 20 aa, synthetic construct
  source 1..20: note = Description of Artificial Sequence: Synthetic peptide
GGGGAGGGGAGGGGAGGGGA

SEQ ID NO: 808 - protein, 25 aa, synthetic construct
  source 1..25: note = Description of Artificial Sequence: Synthetic peptide
GGGGAGGGGAGGGGAGGGGAGGGGA

SEQ ID NO: 809 - protein, 30 aa, synthetic construct
  source 1..30: note = Description of Artificial Sequence: Synthetic polypeptide
GGGGAGGGGAGGGGAGGGGAGGGGAGGGGA

SEQ ID NO: 810 - protein, 35 aa, synthetic construct
  source 1..35: note = Description of Artificial Sequence: Synthetic polypeptide
GGGGAGGGGAGGGGAGGGGAGGGGAGGGGAGGGGA

SEQ ID NO: 811 - protein, 30 aa, synthetic construct
  source 1..30: note = Description of Artificial Sequence: Synthetic polypeptide
DPALVHQRPAPPGGGGSGGGGSGGGGSGGG

SEQ ID NO: 812 - protein, 5 aa, synthetic construct
  source 1..5: note = Description of Artificial Sequence: Synthetic peptide
GKPGS

SEQ ID NO: 813 - protein, 25 aa, synthetic construct
  source 1..25: note = Description of Artificial Sequence: Synthetic peptide
GKPGSGKPGSGKPGSGKPGSGKPGS

SEQ ID NO: 814 - protein, 30 aa, synthetic construct
  source 1..30: note = Description of Artificial Sequence: Synthetic polypeptide
GKPGSGKPGSGKPGSGKPGSGKPGSGKPGS

SEQ ID NO: 815 - protein, 5 aa, synthetic construct
  source 1..5: note = Description of Artificial Sequence: Synthetic peptide
GGGES

SEQ ID NO: 816 - protein, 9 aa, synthetic construct
  source 1..9: note = Description of Artificial Sequence: Synthetic peptide
KTHTCPPCP

SEQ ID NO: 817 - protein, 15 aa, synthetic construct
  source 1..15: note = Description of Artificial Sequence: Synthetic peptide
EPKSSDKTHTCPPCP

SEQ ID NO: 818 - protein, 19 aa, synthetic construct
  source 1..19: note = Description of Artificial Sequence: Synthetic peptide
GGGGSGGGGSKTHTCPPCP

SEQ ID NO: 819 - protein, 19 aa, synthetic construct
  source 1..19: note = Description of Artificial Sequence: Synthetic peptide
GKPGSGKPGSKTHTCPPCP

SEQ ID NO: 820 - protein, 14 aa, synthetic construct
  source 1..14: note = Description of Artificial Sequence: Synthetic peptide
GKPGSKTHTCPPCP

SEQ ID NO: 821 - protein, 5 aa, synthetic construct
  source 1..5: note = Description of Artificial Sequence: Synthetic peptide
EPKSC

SEQ ID NO: 822 - protein, 15 aa, synthetic construct
  source 1..15: note = Description of Artificial Sequence: Synthetic peptide
EPKSCGGGGSGGGGS

SEQ ID NO: 823 - protein, 216 aa, synthetic construct
  source 1..216: note = Description of Artificial Sequence: Synthetic polypeptide; note = Heterodimeric Fc Backbone 1 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 824 - protein, 216 aa, synthetic construct
  source 1..216: note = Description of Artificial Sequence: Synthetic polypeptide; note = Heterodimeric Fc Backbone 1 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 825 - protein, 216 aa, synthetic construct; identical to SEQ ID NO: 823
  source 1..216: note = Description of Artificial Sequence: Synthetic polypeptide; note = Heterodimeric Fc Backbone 2 monomer 1 (-)

SEQ ID NO: 826 - protein, 216 aa, synthetic construct
  source 1..216: note = Description of Artificial Sequence: Synthetic polypeptide; note = Heterodimeric Fc Backbone monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 827 - protein, 216 aa, synthetic construct
  source 1..216: note = Description of Artificial Sequence: Synthetic polypeptide; note = Heterodimeric Fc Backbone 3 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 828 - protein, 216 aa, synthetic construct; identical to SEQ ID NO: 826
  source 1..216: note = Description of Artificial Sequence: Synthetic polypeptide; note = Heterodimeric Fc Backbone 3 monomer 2 (+)

SEQ ID NO: 829 - protein, 216 aa, synthetic construct
  source 1..216: note = Description of Artificial Sequence: Synthetic polypeptide; note = Heterodimeric Fc Backbone 4 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 830 - protein, 216 aa, synthetic construct
  source 1..216: note = Description of Artificial Sequence: Synthetic polypeptide; note = Heterodimeric Fc Backbone 4 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 831 - protein, 216 aa, synthetic construct
  source 1..216: note = Description of Artificial Sequence: Synthetic polypeptide; note = Heterodimeric Fc Backbone 5 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 832 - protein, 216 aa, synthetic construct
  source 1..216: note = Description of Artificial Sequence: Synthetic polypeptide; note = Heterodimeric Fc Backbone 5 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 833 - protein, 216 aa, synthetic construct
  source 1..216: note = Description of Artificial Sequence: Synthetic polypeptide; note = Heterodimeric Fc Backbone 6 monomer 1 (-)
APPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 834 - protein, 216 aa, synthetic construct
  source 1..216: note = Description of Artificial Sequence: Synthetic polypeptide; note = Heterodimeric Fc Backbone 6 monomer 2 (+)
APPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 835 - protein, 216 aa, synthetic construct
  source 1..216: note = Description of Artificial Sequence: Synthetic polypeptide; note = Heterodimeric Fc Backbone 7 monomer 1 (-)
APPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 836 - protein, 216 aa, synthetic construct
  source 1..216: note = Description of Artificial Sequence: Synthetic polypeptide; note = Heterodimeric Fc Backbone 7 monomer 2 (+)
APPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 837 - protein, 217 aa, synthetic construct
  source 1..217: note = Description of Artificial Sequence: Synthetic polypeptide; note = Heterodimeric Fc Backbone 8 monomer 1 (-)
APEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 838 - protein, 217 aa, synthetic construct
  source 1..217: note = Description of Artificial Sequence: Synthetic polypeptide; note = Heterodimeric Fc Backbone 8 monomer 2 (+)
APEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 839 - protein, 216 aa, synthetic construct
  source 1..216: note = Description of Artificial Sequence: Synthetic polypeptide; note = Heterodimeric Fc Backbone 9 monomer 1 (-)
APPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 840 - protein, 216 aa, synthetic construct
  source 1..216: note = Description of Artificial Sequence: Synthetic polypeptide; note = Heterodimeric Fc Backbone 9 monomer 2 (+)
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 841 - protein, 216 aa, synthetic construct
  source 1..216: note = Description of Artificial Sequence: Synthetic polypeptide; note = Heterodimeric Fc Backbone 10 monomer 1 (-)
APPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 842 - protein, 216 aa, synthetic construct
  source 1..216: note = Description of Artificial Sequence: Synthetic polypeptide; note = Heterodimeric Fc Backbone 10 monomer 2 (+)
APPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 843 - protein, 216 aa, synthetic construct
  source 1..216: note = Description of Artificial Sequence: Synthetic polypeptide; note = Heterodimeric Fc Backbone 11 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 844 - protein, 216 aa, synthetic construct
  source 1..216: note = Description of Artificial Sequence: Synthetic polypeptide; note = Heterodimeric Fc Backbone 11 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 845 - protein, 216 aa, synthetic construct
  source 1..216: note = Description of Artificial Sequence: Synthetic polypeptide; note = Heterodimeric Fc Backbone 12 monomer 1 (-)
APPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 846 - protein, 216 aa, synthetic construct; identical to SEQ ID NO: 823
  source 1..216: note = Description of Artificial Sequence: Synthetic polypeptide; note = Heterodimeric Fc Backbone 12 monomer 2 (+)

SEQ ID NO: 847 - protein, 215 aa, synthetic construct
  source 1..215: note = Description of Artificial Sequence: Synthetic polypeptide; note = 2 + 1 mAb-scFv Heterodimeric Fc Backbone monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPK

SEQ ID NO: 848 - protein, 214 aa, synthetic construct
  source 1..214: note = Description of Artificial Sequence: Synthetic polypeptide; note = 2 + 1 mAb-scFv Heterodimeric Fc Backbone monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSP

SEQ ID NO: 849 - protein, 113 aa, synthetic construct
  source 1..113: note = Description of Artificial Sequence: Synthetic polypeptide; note = IgG1 CH1(+) + hinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCP

SEQ ID NO: 850 - protein, 113 aa, synthetic construct
  source 1..113: note = Description of Artificial Sequence: Synthetic polypeptide; note = IgG1 CH1(-) + hinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCP

SEQ ID NO: 851 - protein, 110 aa, synthetic construct
  source 1..110: note = Description of Artificial Sequence: Synthetic polypeptide; note = IgG2 CH1(+) + hinge
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCP

SEQ ID NO: 852 - protein, 110 aa, synthetic construct
  source 1..110: note = Description of Artificial Sequence: Synthetic polypeptide; note = IgG2 CH1(-) + hinge
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCP

SEQ ID NO: 853 - protein, 110 aa, synthetic construct
  source 1..110: note = Description of Artificial Sequence: Synthetic polypeptide; note = IgG4 CH1(+) + hinge
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCP

SEQ ID NO: 854 - protein, 110 aa, synthetic construct
  source 1..110: note = Description of Artificial Sequence: Synthetic polypeptide; note = IgG4 CH1(-) + hinge
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPSCP

SEQ ID NO: 855 - protein, 103 aa, synthetic construct
  source 1..103: note = Description of Artificial Sequence: Synthetic polypeptide; note = IgG1 CH1(+) + half hinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 856 - protein, 103 aa, synthetic construct
  source 1..103: note = Description of Artificial Sequence: Synthetic polypeptide; note = IgG1 CH1(-) + half hinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSC

SEQ ID NO: 857 - protein, 98 aa, synthetic construct
  source 1..98: note = Description of Artificial Sequence: Synthetic polypeptide; note = IgG1 CH1(+)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 858 - protein, 98 aa, synthetic construct
  source 1..98: note = Description of Artificial Sequence: Synthetic polypeptide; note = IgG1 CH1(-)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKV

SEQ ID NO: 859 - protein, 98 aa, synthetic construct
  source 1..98: note = Description of Artificial Sequence: Synthetic polypeptide; note = IgG2 CH1(+)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 860 - protein, 98 aa, synthetic construct
  source 1..98: note = Description of Artificial Sequence: Synthetic polypeptide; note = IgG2 CH1(-)
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTV

SEQ ID NO: 861 - protein, 98 aa, synthetic construct
  source 1..98: note = Description of Artificial Sequence: Synthetic polypeptide; note = IgG4 CH1(+)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 862 - protein, 98 aa, synthetic construct
  source 1..98: note = Description of Artificial Sequence: Synthetic polypeptide; note = IgG4 CH1(-)
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRV

SEQ ID NO: 863 - protein, 15 aa, synthetic construct
  source 1..15: note = Description of Artificial Sequence: Synthetic peptide; note = IgG1 hinge
EPKSCDKTHTCPPCP

SEQ ID NO: 864 - protein, 12 aa, synthetic construct
  source 1..12: note = Description of Artificial Sequence: Synthetic peptide; note = IgG2 hinge
ERKCCVECPPCP

SEQ ID NO: 865 - protein, 12 aa, synthetic construct
  source 1..12: note = Description of Artificial Sequence: Synthetic peptide; note = IgG4 hinge
ESKYGPPCPSCP

SEQ ID NO: 866 - protein, 107 aa, synthetic construct [sequence omitted]

SEQ ID NO: 867 - protein, 106 aa, synthetic construct
  source 1..106: note = Description of Artificial Sequence: Synthetic polypeptide; note = Light Chain Constant Domain - Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 868 - protein, 442 aa, synthetic construct
  source 1..442: note = Description of Artificial Sequence: Synthetic polypeptide; note = XENP16432 Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 869 - protein, 214 aa, synthetic construct
  source 1..214: note = Description of Artificial Sequence: Synthetic polypeptide; note = XENP16432 Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 870 - protein, 121 aa, synthetic construct
  source 1..121: note = Description of Artificial Sequence: Synthetic polypeptide; note = 1A7[CD28]_H1L1 Variable heavy (vh) domain
EVQLLESGGGLVQPGGSLRLSCAASGFTFSSYAMSWVRQAPGKGLEWVSTISGSGDSTYYADSVKGRFTISRDNSKNTLYLQMNSLRAEDTAVYYCAKSGPGLRQVGFDYWGQGTLVTVSS

SEQ ID NO: 871 - protein, 5 aa, synthetic construct
  source 1..5: note = Description of Artificial Sequence: Synthetic peptide; note = 1A7[CD28]_H1L1 vhCDR1
SYAMS

SEQ ID NO: 872 - protein, 17 aa, synthetic construct
  source 1..17: note = Description of Artificial Sequence: Synthetic peptide; note = 1A7[CD28]_H1L1 vhCDR2
TISGSGDSTYYADSVKG

SEQ ID NO: 873 - protein, 12 aa, synthetic construct
  source 1..12: note = Description of Artificial Sequence: Synthetic peptide; note = 1A7[CD28]_H1L1 vhCDR3
SGPGLRQVGFDY

SEQ ID NO: 874 - protein, 107 aa, synthetic construct
  source 1..107: note = Description of Artificial Sequence: Synthetic polypeptide; note = 1A7[CD28]_H1L1 Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 875 - protein, 11 aa, synthetic construct
  source 1..11: note = Description of Artificial Sequence: Synthetic peptide; note = 1A7[CD28]_H1L1 vlCDR1
RASQSISSYLN

SEQ ID NO: 876 - protein, 7 aa, synthetic construct
  source 1..7: note = Description of Artificial Sequence: Synthetic peptide; note = 1A7[CD28]_H1L1 vlCDR2
AASSLQS

SEQ ID NO: 877 - protein, 9 aa, synthetic construct
  source 1..9: note = Description of Artificial Sequence: Synthetic peptide; note = 1A7[CD28]_H1L1 vlCDR3
QQSYSTPFT

SEQ ID NO: 878 - protein, 450 aa, synthetic construct
  source 1..450: note = Description of Artificial Sequence: Synthetic polypeptide; note = XENP28428 Heavy Chain
EVQLLESGGGLVQPGGSLRLSCAASGFTFSSYAMSWVRQAPGKGLEWVSTISGSGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 879 - protein, 214 aa, synthetic construct
  source 1..214: note = Description of Artificial Sequence: Synthetic polypeptide; note = XENP28428 Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 880 - protein, 121 aa, synthetic construct; identical to SEQ ID NO: 585
  source 1..121: note = Description of Artificial Sequence: Synthetic polypeptide; note = Variable heavy (vh) domain 1A7_H1.1

SEQ ID NO: 881 - protein, 5 aa, synthetic construct
  source 1..5: note = Description of Artificial Sequence: Synthetic peptide; note = vhCDR1
SYYMS

SEQ ID NO: 882 - protein, 17 aa, synthetic construct
  source 1..17: note = Description of Artificial Sequence: Synthetic peptide; note = vhCDR2
TISGSGDSTYYADSVKG

SEQ ID NO: 883 - protein, 12 aa, synthetic construct
  source 1..12: note = Description of Artificial Sequence: Synthetic peptide; note = vhCDR3
SGPGLRQVGFDY

SEQ ID NO: 884 - protein, 121 aa, synthetic construct; identical to SEQ ID NO: 598
  source 1..121: note = Description of Artificial Sequence: Synthetic polypeptide; note = Variable heavy (vh) domain 1A7_H1.14

SEQ ID NO: 885 - protein, 5 aa, synthetic construct
  source 1..5: note = Description of Artificial Sequence: Synthetic peptide; note = vhCDR1
SYYMS

SEQ ID NO: 886 - protein, 17 aa, synthetic construct
  source 1..17: note = Description of Artificial Sequence: Synthetic peptide; note = vhCDR2
TISESGDSTYYADSVKG

SEQ ID NO: 887 - protein, 12 aa, synthetic construct
  source 1..12: note = Description of Artificial Sequence: Synthetic peptide; note = vhCDR3
SGPGLRQVGFDY

SEQ ID NO: 888 - protein, 107 aa, synthetic construct; identical to SEQ ID NO: 722
  source 1..107: note = Description of Artificial Sequence: Synthetic polypeptide; note = Variable heavy (vh) domain 1A7_L1.71

SEQ ID NO: 889 - protein, 11 aa, synthetic construct
  source 1..11: note = Description of Artificial Sequence: Synthetic peptide; note = vhCDR1
RASQSISSYLN

SEQ ID NO: 890 - protein, 7 aa, synthetic construct
  source 1..7: note = Description of Artificial Sequence: Synthetic peptide; note = vhCDR2
AASSLQS

SEQ ID NO: 891 - protein, 9 aa, synthetic construct
  source 1..9: note = Description of Artificial Sequence: Synthetic peptide; note = vhCDR3
QQVYSTPFT

SEQ ID NO: 892 - protein, 121 aa, synthetic construct; identical to SEQ ID NO: 870
  source 1..121: note = Description of Artificial Sequence: Synthetic polypeptide; note = 1A7[CD28]_H1_L1.71 Variable Heavy (vh) Domain

SEQ ID NO: 893 - protein, 5 aa, synthetic construct
  source 1..5: note = Description of Artificial Sequence: Synthetic peptide; note = 1A7[CD28]_H1_L1.71 vhCDR1
SYAMS

SEQ ID NO: 894 - protein, 17 aa, synthetic construct
  source 1..17: note = Description of Artificial Sequence: Synthetic peptide; note = 1A7[CD28]_H1_L1.71 vhCDR2
TISGSGDSTYYADSVKG

SEQ ID NO: 895 - protein, 12 aa, synthetic construct
  source 1..12: note = Description of Artificial Sequence: Synthetic peptide; note = 1A7[CD28]_H1_L1.71 vhCDR3
SGPGLRQVGFDY

SEQ ID NO: 896 - protein, 107 aa, synthetic construct; identical to SEQ ID NO: 722
  source 1..107: note = Description of Artificial Sequence: Synthetic polypeptide; note = 1A7[CD28]_H1_L1.71 Variable Light (vl) Domain

SEQ ID NO: 897 - protein, 11 aa, synthetic construct
  source 1..11: note = Description of Artificial Sequence: Synthetic peptide; note = 1A7[CD28]_H1_L1.71 vlCDR1
RASQSISSYLN

SEQ ID NO: 898 - protein, 7 aa, synthetic construct
  source 1..7: note = Description of Artificial Sequence: Synthetic peptide; note = 1A7[CD28]_H1_L1.71 vlCDR2
AASSLQS

SEQ ID NO: 899 - protein, 9 aa, synthetic construct
  source 1..9: note = Description of Artificial Sequence: Synthetic peptide; note = 1A7[CD28]_H1_L1.71 vlCDR3
QQVYSTPFT

SEQ ID NO: 900 - protein, 121 aa, synthetic construct; identical to SEQ ID NO: 585
  source 1..121: note = Description of Artificial Sequence: Synthetic polypeptide; note = 1A7[CD28]_H1.1_L1.71 Variable Heavy (vh) Domain

SEQ ID NO: 901 - protein, 5 aa, synthetic construct
  source 1..5: note = Description of Artificial Sequence: Synthetic peptide; note = 1A7[CD28]_H1.1_L1.71 vhCDR1
SYYMS

SEQ ID NO: 902 - protein, 17 aa, synthetic construct
  source 1..17: note = Description of Artificial Sequence: Synthetic peptide; note = 1A7[CD28]_H1.1_L1.71 vhCDR2
TISGSGDSTYYADSVKG

SEQ ID NO: 903 - protein, 12 aa, synthetic construct
  source 1..12: note = Description of Artificial Sequence: Synthetic peptide; note = 1A7[CD28]_H1.1_L1.71 vhCDR3
SGPGLRQVGFDY

SEQ ID NO: 904 - protein, 107 aa, synthetic construct; identical to SEQ ID NO: 722
  source 1..107: note = Description of Artificial Sequence: Synthetic polypeptide; note = 1A7[CD28]_H1.1_L1.71 Variable Light (vl) Domain

SEQ ID NO: 905 - protein, 11 aa, synthetic construct
  source 1..11: note = Description of Artificial Sequence: Synthetic peptide; note = 1A7[CD28]_H1.1_L1.71 vlCDR1
RASQSISSYLN

SEQ ID NO: 906 - protein, 7 aa, synthetic construct
  source 1..7: note = Description of Artificial Sequence: Synthetic peptide; note = 1A7[CD28]_H1.1_L1.71 vlCDR2
AASSLQS

SEQ ID NO: 907 - protein, 9 aa, synthetic construct
  source 1..9: note = Description of Artificial Sequence: Synthetic peptide; note = 1A7[CD28]_H1.1_L1.71 vlCDR3
QQVYSTPFT

SEQ ID NO: 908 - protein, 121 aa, synthetic construct; identical to SEQ ID NO: 598
  source 1..121: note = Description of Artificial Sequence: Synthetic polypeptide; note = 1A7[CD28]_H1.14_L1 Variable Heavy (vh) Domain

SEQ ID NO: 909 - protein, 5 aa, synthetic construct
  source 1..5: note = Description of Artificial Sequence: Synthetic peptide; note = 1A7[CD28]_H1.14_L1 vhCDR1
SYYMS

SEQ ID NO: 910 - protein, 17 aa, synthetic construct
  source 1..17: note = Description of Artificial Sequence: Synthetic peptide; note = 1A7[CD28]_H1.14_L1 vhCDR2
TISESGDSTYYADSVKG

SEQ ID NO: 911 - protein, 12 aa, synthetic construct
  source 1..12: note = Description of Artificial Sequence: Synthetic peptide; note = 1A7[CD28]_H1.14_L1 vhCDR3
SGPGLRQVGFDY

SEQ ID NO: 912 - protein, 107 aa, synthetic construct; identical to SEQ ID NO: 874
  source 1..107: note = Description of Artificial Sequence: Synthetic polypeptide; note = 1A7[CD28]_H1.14_L1 Variable Light (vl) Domain

SEQ ID NO: 913 - protein, 11 aa, synthetic construct
  source 1..11: note = Description of Artificial Sequence: Synthetic peptide; note = 1A7[CD28]_H1.14_L1 vlCDR1
RASQSISSYLN

SEQ ID NO: 914 - protein, 7 aa, synthetic construct
  source 1..7: note = Description of Artificial Sequence: Synthetic peptide; note = 1A7[CD28]_H1.14_L1 vlCDR2
AASSLQS

SEQ ID NO: 915 - protein, 9 aa, synthetic construct
  source 1..9: note = Description of Artificial Sequence: Synthetic peptide; note = 1A7[CD28]_H1.14_L1 vlCDR3
QQSYSTPFT

SEQ ID NO: 916 - protein, 121 aa, synthetic construct; identical to SEQ ID NO: 598
  source 1..121: note = Description of Artificial Sequence: Synthetic polypeptide; note = 1A7[CD28]_H1.14_L1.71 Variable Heavy (vh) Domain

SEQ ID NO: 917 - protein, 5 aa, synthetic construct
  source 1..5: note = Description of Artificial Sequence: Synthetic peptide; note = 1A7[CD28]_H1.14_L1.71 vhCDR1
SYYMS

SEQ ID NO: 918 - protein, 17 aa, synthetic construct
  source 1..17: note = Description of Artificial Sequence: Synthetic peptide; note = 1A7[CD28]_H1.14_L1.71 vhCDR2
TISESGDSTYYADSVKG

SEQ ID NO: 919 - protein, 12 aa, synthetic construct
  source 1..12: note = Description of Artificial Sequence: Synthetic peptide; note = 1A7[CD28]_H1.14_L1.71 vhCDR3
SGPGLRQVGFDY

SEQ ID NO: 920 - protein, 107 aa, synthetic construct; identical to SEQ ID NO: 722
  source 1..107: note = Description of Artificial Sequence: Synthetic polypeptide; note = 1A7[CD28]_H1.14_L1.71 Variable Light (vl) Domain

SEQ ID NO: 921 - protein, 11 aa, synthetic construct
  source 1..11: note = Description of Artificial Sequence: Synthetic peptide; note = 1A7[CD28]_H1.14_L1.71 vlCDR1
RASQSISSYLN

SEQ ID NO: 922 - protein, 7 aa, synthetic construct
  source 1..7: note = Description of Artificial Sequence: Synthetic peptide; note = 1A7[CD28]_H1.14_L1.71 vlCDR2
AASSLQS

SEQ ID NO: 923 - protein, 9 aa, synthetic construct
  source 1..9: note = Description of Artificial Sequence: Synthetic peptide; note = 1A7[CD28]_H1.14_L1.71 vlCDR3
QQVYSTPFT

SEQ ID NO: 924 - protein, 450 aa, synthetic construct
  source 1..450: note = Description of Artificial Sequence: Synthetic polypeptide; note = XENP27181 Heavy Chain
QVQLQESGPGLVKPSETLSLTCAVSGFSLTSYGVHWIRQPPGKGLEWLGVIWPGGGTNFNSALMSRLTISEDTSKNQVSLKLSSVTAADTAVYYCARDRAYGNYLYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 925 - protein, 218 aa, synthetic construct
  source 1..218: note = Description of Artificial Sequence: Synthetic polypeptide; note = XENP27181 Light Chain
DIQMTQSPSSLSASVGDRVTITCRASESVEYYVTSLMQWYQQKPGKAPKLLIYAASNVDSGVPSRFSGSGSGTDFTLTISSLQPEDIATYYCQQSRKVPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 926 - protein, 231 aa, synthetic construct
  source 1..231: note = Description of Artificial Sequence: Synthetic polypeptide; note = XENP27656 Chain 1 - empty-Fc(216)_IgG1_pI(-)_Isosteric_A_C220S/PVA_/S267K/L368D /K370S empty-Fc Heavy Chain
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 927 - protein, 483 aa, synthetic construct
  source 1..483: note = Description of Artificial Sequence: Synthetic polypeptide; note = XENP27656 Chain 2 - HuTN228[CD28]_H1L1_scFv(GKPGS)4-Fc(216)_IgG1_C220S/PVA_/S26 7K/S364K/E357Q scFv-Fc Heavy Chain
QVQLQESGPGLVKPSETLSLTCAVSGFSLTSYGVHWIRQPPGKGLEWLGVIWPGGGTNFNSALMSRLTISEDTSKNQVSLKLSSVTAADTAVYYCARDRAYGNYLYAMDYWGQGTLVTVSSGKPGSGKPGSGKPGSGKPGSDIQMTQSPSSLSASVGDRVTITCRASESVEYYVTSLMQWYQQKPGKAPKLLIYAASNVDSGVPSRFSGSGSGTDFTLTISSLQPEDIATYYCQQSRKVPFTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 928 - protein, 119 aa, synthetic construct
  source 1..119: note = Description of Artificial Sequence: Synthetic polypeptide; note = 2E4A3.189[B7H3]_H1L1 Variable heavy (vh) domain
QVQLVQSGAEVKKPGASVKVSCKASGYIFTNYYMHWVRQAPGQGLEWMGIISPSAGTTSYAQKFQGRVTMTRDTSTSTVYMELSSLRSEDTAVYYCARGGGSSPRLDYWGQGTLVTVSS

SEQ ID NO: 929 - protein, 5 aa, synthetic construct
  source 1..5: note = Description of Artificial Sequence: Synthetic peptide; note = 2E4A3.189[B7H3]_H1L1 vhCDR1
NYYMH

SEQ ID NO: 930 - protein, 17 aa, synthetic construct
  source 1..17: note = Description of Artificial Sequence: Synthetic peptide; note = 2E4A3.189[B7H3]_H1L1 vhCDR2
IISPSAGTTSYAQKFQG

SEQ ID NO: 931 - protein, 10 aa, synthetic construct
  source 1..10: note = Description of Artificial Sequence: Synthetic peptide; note = 2E4A3.189[B7H3]_H1L1 vhCDR3
GGGSSPRLDY

SEQ ID NO: 932 - protein, 107 aa, synthetic construct
  source 1..107: note = Description of Artificial Sequence: Synthetic polypeptide; note = 2E4A3.189[B7H3]_H1L1 Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 933 - protein, 11 aa, synthetic construct
  source 1..11: note = Description of Artificial Sequence: Synthetic peptide; note = 2E4A3.189[B7H3]_H1L1 vlCDR1
RASQSISSYLN

SEQ ID NO: 934 - protein, 7 aa, synthetic construct
  source 1..7: note = Description of Artificial Sequence: Synthetic peptide; note = 2E4A3.189[B7H3]_H1L1 vlCDR2
AASSLQS

SEQ ID NO: 935 - protein, 9 aa, synthetic construct
  source 1..9: note = Description of Artificial Sequence: Synthetic peptide; note = 2E4A3.189[B7H3]_H1L1 vlCDR3
QQSYSTPYT

SEQ ID NO: 936 - protein, 448 aa, synthetic construct
  source 1..448: note = Description of Artificial Sequence: Synthetic polypeptide; note = XENP32637 Heavy Chain
QVQLVQSGAEVKKPGASVKVSCKASGYIFTNYYMHWVRQAPGQGLEWMGIISPSAGTTSYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 937 - protein, 214 aa, synthetic construct
  source 1..214: note = Description of Artificial Sequence: Synthetic polypeptide; note = XENP32637 Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 938 - protein, 119 aa, synthetic construct; identical to SEQ ID NO: 499
  source 1..119: note = Description of Artificial Sequence: Synthetic polypeptide; note = Variable heavy (vh) domain 2E4A3.189_H1.3

SEQ ID NO: 939 - protein, 5 aa, synthetic construct
  source 1..5: note = Description of Artificial Sequence: Synthetic peptide; note = vhCDR1
NHYMH

SEQ ID NO: 940 - protein, 17 aa, synthetic construct
  source 1..17: note = Description of Artificial Sequence: Synthetic peptide; note = vhCDR2
IISPSAGSTDYAQKFQG

SEQ ID NO: 941 - protein, 10 aa, synthetic construct
  source 1..10: note = Description of Artificial Sequence: Synthetic peptide; note = vhCDR3
GGGSSPRLDY

SEQ ID NO: 942 - protein, 119 aa, synthetic construct; identical to SEQ ID NO: 518
  source 1..119: note = Description of Artificial Sequence: Synthetic polypeptide; note = Variable heavy (vh) domain 2E4A3.189_H1.22

SEQ ID NO: 943 - protein, 5 aa, synthetic construct
  source 1..5: note = Description of Artificial Sequence: Synthetic peptide; note = vhCDR1
NNYMH

SEQ ID NO: 944 - protein, 17 aa, synthetic construct
  source 1..17: note = Description of Artificial Sequence: Synthetic peptide; note = vhCDR2
IISPSVGRTAYAQKFQG

SEQ ID NO: 945 - protein, 10 aa, synthetic construct
  source 1..10: note = Description of Artificial Sequence: Synthetic peptide; note = vhCDR3
GGGSSPRLDY

SEQ ID NO: 946 - protein, 121 aa, synthetic construct
  source 1..121: note = Description of Artificial Sequence: Synthetic polypeptide; note = 6A1[B7H3]_H1L1 Variable heavy (vh) domain
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSS

SEQ ID NO: 947 - protein, 5 aa, synthetic construct
  source 1..5: note = Description of Artificial Sequence: Synthetic peptide; note = 6A1[B7H3]_H1L1 vhCDR1
NYYMA

SEQ ID NO: 948 - protein, 17 aa, synthetic construct
  source 1..17: note = Description of Artificial Sequence: Synthetic peptide; note = 6A1[B7H3]_H1L1 vhCDR2
SISTGGGSTYYRDSVKG

SEQ ID NO: 949 - protein, 12 aa, synthetic construct
  source 1..12: note = Description of Artificial Sequence: Synthetic peptide; note = 6A1[B7H3]_H1L1 vhCDR3
DLSAIAATPFAY

SEQ ID NO: 950 - protein, 106 aa, synthetic construct
  source 1..106: note = Description of Artificial Sequence: Synthetic polypeptide; note = 6A1[B7H3]_H1L1 Variable light (vl) domain
DIQMTQSPSSLSASVGDRVTITCRASQNIYTSLAWYQQKPGKAPKLLIYNAHSLQTGIPSRFSGSGSGADFTLTISSLQPEDFATYFCQQYYSGLTFGSGTKLEIK

SEQ ID NO: 951 - protein, 11 aa, synthetic construct
  source 1..11: note = Description of Artificial Sequence: Synthetic peptide; note = 6A1[B7H3]_H1L1 vlCDR1
RASQNIYTSLA

SEQ ID NO: 952 - protein, 7 aa, synthetic construct
  source 1..7: note = Description of Artificial Sequence: Synthetic peptide; note = 6A1[B7H3]_H1L1 vlCDR2
NAHSLQT

SEQ ID NO: 953 - protein, 8 aa, synthetic construct
  source 1..8: note = Description of Artificial Sequence: Synthetic peptide; note = 6A1[B7H3]_H1L1 vlCDR3
QQYYSGLT

SEQ ID NO: 954 - protein, 450 aa, synthetic construct
  source 1..450: note = Description of Artificial Sequence: Synthetic polypeptide; note = XENP33383 Heavy Chain
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 955 - protein, 213 aa, synthetic construct
  source 1..213: note = Description of Artificial Sequence: Synthetic polypeptide; note = XENP33383 Light Chain
DIQMTQSPSSLSASVGDRVTITCRASQNIYTSLAWYQQKPGKAPKLLIYNAHSLQTGIPSRFSGSGSGADFTLTISSLQPEDFATYFCQQYYSGLTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 956 - protein, 119 aa, synthetic construct
  source 1..119: note = Description of Artificial Sequence: Synthetic polypeptide; note = 3C4[B7H3]_H1L1.1 Variable heavy (vh) domain
QVQLVQSGAEVKKPGASVKVSCKVSGFSLTSYHVSWVRQAPGQGLEWMGAISSGGSSYYNSKFQGRVTMTRDTSTSTVYMELSSLRSEDTAVYFCTGDLGAAISWFAYWGQGTLVTVSS

SEQ ID NO: 957 - protein, 10 aa, synthetic construct
  source 1..10: note = Description of Artificial Sequence: Synthetic peptide; note = 3C4[B7H3]_H1L1.1 vhCDR1
GFSLTSYHVS

SEQ ID NO: 958 - protein, 16 aa, synthetic construct
  source 1..16: note = Description of Artificial Sequence: Synthetic peptide; note = 3C4[B7H3]_H1L1.1 vhCDR2
AISSGGSSYYNSKFQG

SEQ ID NO: 959 - protein, 11 aa, synthetic construct
  source 1..11: note = Description of Artificial Sequence: Synthetic peptide; note = 3C4[B7H3]_H1L1.1 vhCDR3
DLGAAISWFAY

SEQ ID NO: 960 - protein, 106 aa, synthetic construct
  source 1..106: note = Description of Artificial Sequence: Synthetic polypeptide; note = 3C4[B7H3]_H1L1.1 Variable light (vl) domain
DIQMTQSPSSLSASVGDRVTITCRTSQSIYKSLAWYQQKPGKAPKLLIYNAHSLQTGIPSRFSGSGSGTDFTLTISSLQPEDFATYFCQQYYSGLTFGSGTKLEIK

SEQ ID NO: 961 - protein, 11 aa, synthetic construct
  source 1..11: note = Description of Artificial Sequence: Synthetic peptide; note = 3C4[B7H3]_H1L1.1 vlCDR1
RTSQSIYKSLA

SEQ ID NO: 962 - protein, 7 aa, synthetic construct
  source 1..7: note = Description of Artificial Sequence: Synthetic peptide; note = 3C4[B7H3]_H1L1.1 vlCDR2
NAHSLQT

SEQ ID NO: 963 - protein, 8 aa, synthetic construct
  source 1..8: note = Description of Artificial Sequence: Synthetic peptide; note = 3C4[B7H3]_H1L1.1 vlCDR3
QQYYSGLT

SEQ ID NO: 964 - protein, 122 aa, synthetic construct
  source 1..122: note = Description of Artificial Sequence: Synthetic polypeptide; note = 4F12[B7H3]_H2L1.1 Variable heavy (vh) domain
EVQLVESGGGLVKPGGSLRLSCAASGFSFSVGYYMCWVRQAPGKGLEWVSCIYVGSGSSGSTYYASVKGRFTISSDTAKTSVYLQMNSLRAEDTAVYFCARTAGSDWRLDLWGQGTLVTVSS

SEQ ID NO: 965 - protein, 6 aa, synthetic construct
  source 1..6: note = Description of Artificial Sequence: Synthetic peptide; note = 4F12[B7H3]_H2L1.1 vhCDR1
VGYYMC

SEQ ID NO: 966 - protein, 19 aa, synthetic construct
  source 1..19: note = Description of Artificial Sequence: Synthetic peptide; note = 4F12[B7H3]_H2L1.1 vhCDR2
CIYVGSGSSGSTYYASVKG

SEQ ID NO: 967 - protein, 10 aa, synthetic construct
  source 1..10: note = Description of Artificial Sequence: Synthetic peptide; note = 4F12[B7H3]_H2L1.1 vhCDR3
TAGSDWRLDL

SEQ ID NO: 968 - protein, 108 aa, synthetic construct
  source 1..108: note = Description of Artificial Sequence: Synthetic polypeptide; note = 4F12[B7H3]_H2L1.1 Variable light (vl) domain
DIVMTQSPSSLSASVGDRVTITCRASQSIANELSWYQQKPGKPPKLLIYRASTLTSGVPSRFKGSGSGTDFTLTISSLQPEDFATYYCQSTYNGRAIGFGGGTKVEIK

SEQ ID NO: 969 - protein, 11 aa, synthetic construct
  source 1..11: note = Description of Artificial Sequence: Synthetic peptide; note = 4F12[B7H3]_H2L1.1 vlCDR1
RASQSIANELS

SEQ ID NO: 970 - protein, 7 aa, synthetic construct
  source 1..7: note = Description of Artificial Sequence: Synthetic peptide; note = 4F12[B7H3]_H2L1.1 vlCDR2
RASTLTS

SEQ ID NO: 971 - protein, 10 aa, synthetic construct
  source 1..10: note = Description of Artificial Sequence: Synthetic peptide; note = 4F12[B7H3]_H2L1.1 vlCDR3
QSTYNGRAIG

SEQ ID NO: 972 - protein, 117 aa, synthetic construct
  source 1..117: note = Description of Artificial Sequence: Synthetic polypeptide; note = 38E2[B7H3]_H2L1.1 Variable heavy (vh) domain
EVQLLESGGGLVQPGGSLRLSCAVSGFSLSSYGVIWVRQAPGKGLEYVSWVSSGGSTNYASSVKGRFTISRDTSKNTVYLQMNSLRAEDTAVYFCARGATNSGTDIWGPGTLVTVSS

SEQ ID NO: 973 - protein, 5 aa, synthetic construct
  source 1..5: note = Description of Artificial Sequence: Synthetic peptide; note = 38E2[B7H3]_H2L1.1 vhCDR1
SYGVI

SEQ ID NO: 974 - protein, 16 aa, synthetic construct
  source 1..16: note = Description of Artificial Sequence: Synthetic peptide; note = 38E2[B7H3]_H2L1.1 vhCDR2
WVSSGGSTNYASSVKG

SEQ ID NO: 975 - protein, 9 aa, synthetic construct
  source 1..9: note = Description of Artificial Sequence: Synthetic peptide; note = 38E2[B7H3]_H2L1.1 vhCDR3
GATNSGTDI

SEQ ID NO: 976 - protein, 110 aa, synthetic construct
  source 1..110: note = Description of Artificial Sequence: Synthetic polypeptide; note = 38E2[B7H3]_H2L1.1 Variable light (vl) domain
DIVMTQSPSSLSASVGDRVTITCRASQSINSWLSWYQQKPGKPPKLLIYGASNLASGVPSRFKGSGSGTDFTLTISSLQPEDFATYYCQNNYGIIAAGATFGGGTKVEIK

SEQ ID NO: 977 - protein, 11 aa, synthetic construct
  source 1..11: note = Description of Artificial Sequence: Synthetic peptide; note = 38E2[B7H3]_H2L1.1 vlCDR1
RASQSINSWLS

SEQ ID NO: 978 - protein, 7 aa, synthetic construct
  source 1..7: note = Description of Artificial Sequence: Synthetic peptide; note = 38E2[B7H3]_H2L1.1 vlCDR2
GASNLAS

SEQ ID NO: 979 - protein, 12 aa, synthetic construct
  source 1..12: note = Description of Artificial Sequence: Synthetic peptide; note = 38E2[B7H3]_H2L1.1 vlCDR3
QNNYGIIAAGAT

SEQ ID NO: 980 - protein, 448 aa, synthetic construct
  source 1..448: note = Description of Artificial Sequence: Synthetic polypeptide; note = XENP34730 Chain 1 - 2E4A3.189[B7H3]_H1.22_Fab_IgG1_pI(-)_Isosteric_A_/PVA_/S267 K/L368D/K370S
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 981 - protein, 479 aa, synthetic construct
  source 1..479: note = Description of Artificial Sequence: Synthetic polypeptide; note = XENP34730 Chain 2 - 1A7[CD28]_H1.14_L1_scFv(GKPGS)4_Fc(216)_IgG1_C220S/PVA_/S26 7K/S364K/E357Q
EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 982 - protein, 214 aa, synthetic construct; identical to SEQ ID NO: 937
  source 1..214: note = Description of Artificial Sequence: Synthetic polypeptide; note = XENP34730 Chain 3 - 2E4A3.189[B7H3]_L1 Light Chain

SEQ ID NO: 983 - protein, 450 aa, synthetic construct
  source 1..450: note = Description of Artificial Sequence: Synthetic polypeptide; note = XENP34732 Chain 1 - 6A1[B7H3]_H1L1_Fab-IgG1_pI(-)_Isosteric_A_/PVA_/S267K/L368D /K370S/M428L/N434S
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 984 - protein, 479 aa, synthetic construct
  source 1..479: note = Description of Artificial Sequence: Synthetic polypeptide; note = XENP34732 Chain 2 - 1A7[CD28]_H1.14_L1_scFv(GKPGS)4-Fc(216)_IgG1_C220S/PVA_/S26 7K/S364K/E357Q/M428L/N434S
EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 985 - protein, 213 aa, synthetic construct; identical to SEQ ID NO: 955
  source 1..213: note = Description of Artificial Sequence: Synthetic polypeptide; note = XENP34732 Chain 3 - 6A1[B7H3]_L1

SEQ ID NO: 986 - protein, 451 aa, synthetic construct
  source 1..451: note = Description of Artificial Sequence: Synthetic polypeptide; note = XENP35151 Chain 1 - 4F12[B7H3]_H2_L1.1_Fab-IgG1_pI(-)_Isosteric_A_/PVA_/S267K/L 368D/K370S/M428L/N434S
EVQLVESGGGLVKPGGSLRLSCAASGFSFSVGYYMCWVRQAPGKGLEWVSCIYVGSGSSGSTYYASVKGRFTISSDTAKTSVYLQMNSLRAEDTAVYFCARTAGSDWRLDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 987 - protein, 479 aa, synthetic construct; identical to SEQ ID NO: 984
  source 1..479: note = Description of Artificial Sequence: Synthetic polypeptide; note = XENP35151 Chain 2 - 1A7[CD28]_H1.14_L1_scFv(GKPGS)4-Fc(216)_IgG1_C220S/PVA_/S26 7K/S364K/E357Q/M428L/N434S

SEQ ID NO: 988 - protein, 215 aa, synthetic construct
  source 1..215: note = Description of Artificial Sequence: Synthetic polypeptide; note = XENP35151 Chain 3 - 4F12[B7H3]_L1.1
DIVMTQSPSSLSASVGDRVTITCRASQSIANELSWYQQKPGKPPKLLIYRASTLTSGVPSRFKGSGSGTDFTLTISSLQPEDFATYYCQSTYNGRAIGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 989 - protein, 446 aa, synthetic construct
  source 1..446: note = Description of Artificial Sequence: Synthetic polypeptide; note = XENP35153 Chain 1 - 38E2[B7H3]_H2_L1.1_Fab-IgG1_pI(-)_Isosteric_A_/PVA_/S267K/L 368D/K370S/M428L/N434S
EVQLLESGGGLVQPGGSLRLSCAVSGFSLSSYGVIWVRQAPGKGLEYVSWVSSGGSTNYASSVKGRFTISRDTSKNTVYLQMNSLRAEDTAVYFCARGATNSGTDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 990 - protein, 479 aa, synthetic construct; identical to SEQ ID NO: 984
  source 1..479: note = Description of Artificial Sequence: Synthetic polypeptide; note = XENP35153 Chain 2 - 1A7[CD28]_H1.14_L1_scFv(GKPGS)4-Fc(216)_IgG1_C220S/PVA_/S26 7K/S364K/E357Q/M428L/N434S

SEQ ID NO: 991 - protein, 217 aa, synthetic construct
  source 1..217: note = Description of Artificial Sequence: Synthetic polypeptide; note = XENP35153 Chain 3 - 38E2[B7H3]_L1.1
DIVMTQSPSSLSASVGDRVTITCRASQSINSWLSWYQQKPGKPPKLLIYGASNLASGVPSRFKGSGSGTDFTLTISSLQPEDFATYYCQNNYGIIAAGATFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 992 - protein, 450 aa, synthetic construct
  source 1..450: note = Description of Artificial Sequence: Synthetic polypeptide; note = XENP34389 Chain 1 - 6A1[B7H3]_H1_Fab_IgG1_pI(-)_Isosteric_A_/PVA_/S267K/L368D/K 370S
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 993 - protein, 717 aa, synthetic construct
  source 1..717: note = Description of Artificial Sequence: Synthetic polypeptide; note = XENP34389 Chain 2 - 6A1[B7H3]_H1_Fab_(G4S)2_1A7[CD28]_H1.14_L1_scFv(GKPGS)4_(G4 S)2_Fc(222)_IgG1_PVA_/S267K/S364K/E357Q
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIKGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 994 - protein, 213 aa, synthetic construct; identical to SEQ ID NO: 955
  source 1..213: note = Description of Artificial Sequence: Synthetic polypeptide; note = XENP34389 Chain 3 - 6A1[B7H3]_L1 Light Chain

SEQ ID NO: 995 - protein, 450 aa, synthetic construct; identical to SEQ ID NO: 983
  source 1..450: note = Description of Artificial Sequence: Synthetic polypeptide; note = XENP34395 Chain 1 - 6A1[B7H3]_H1_Fab-IgG1_pI(-)_Isosteric_A_/PVA_/S267K/L368D/K 370S/M428L/N434S

SEQ ID NO: 996 - protein, 717 aa, synthetic construct
  source 1..717: note = Description of Artificial Sequence: Synthetic polypeptide; note = XENP34395 Chain 2 - 6A1[B7H3]_H1_Fab_(G4S)2_1A7[CD28]_H1.14_L1_scFv(GKPGS)4_(G4 S)2-Fc(222)_IgG1_PVA_/S267K/S364K/E357Q/M428L/N434S
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIKGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 997 - protein, 213 aa, synthetic construct; identical to SEQ ID NO: 955
  source 1..213: note = Description of Artificial Sequence: Synthetic polypeptide; note = XENP34395 Chain 3 - 6A1[B7H3]_L1

SEQ ID NO: 998 - protein, 450 aa, synthetic construct; identical to SEQ ID NO: 992
  source 1..450: note = Description of Artificial Sequence: Synthetic polypeptide; note = XENP34728 Chain 1 - 6A1[B7H3]_H1_Fab_IgG1_pI(-)_Isosteric_A_/PVA_/S267K/L368D/K 370S

SEQ ID NO: 999 - protein, 479 aa, synthetic construct; identical to SEQ ID NO: 981
  source 1..479: note = Description of Artificial Sequence: Synthetic polypeptide; note = XENP34728 Chain 2 - 1A7[CD28]_H1.14_L1_scFv(GKPGS)4_Fc(216)_IgG1_C220S/PVA_/S26 7K/S364K/E357Q

SEQ ID NO: 1000 - protein, 213 aa, synthetic construct; identical to SEQ ID NO: 955
  source 1..213: note = Description of Artificial Sequence: Synthetic polypeptide; note = XENP34728 Chain 3 - 6A1[B7H3]_L1 Light Chain

SEQ ID NO: 1001 - protein, 450 aa, synthetic construct
  source 1..450: note = Description of Artificial Sequence: Synthetic polypeptide; note = XENP34717 Chain 1 - 1A7[CD28]_H1.14_Fab_IgG1_pI(-)_Isosteric_A_PVA_/S267K/L368D /K370S
EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1002 - protein, 448 aa, synthetic construct
  source 1..448: note = Description of Artificial Sequence: Synthetic polypeptide; note = XENP34717 Chain 2 - 2E4A3.189[B7H3]_H1.22_Fab_IgG1_PVA_/S267K/S364K/E357Q
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1003 - protein, 214 aa, synthetic construct; identical to SEQ ID NO: 879
  source 1..214: note = Description of Artificial Sequence: Synthetic polypeptide; note = XENP34717 Chain 3 - 1A7[CD28]_L1 Light Chain

SEQ ID NO: 1004 - protein, 450 aa, synthetic construct; identical to SEQ ID NO: 1001
  source 1..450: note = Description of Artificial Sequence: Synthetic polypeptide; note = XENP34336 Chain 1 -1A7[CD28]_H1.14_L1_Fab-IgG1_pI(-)_Isosteric_A_PVA_/S267K/L 368D/K370S

SEQ ID NO: 1005 - protein, 680 aa, synthetic construct
  source 1..680: note = Description of Artificial Sequence: Synthetic polypeptide; note = XENP34336 Chain 2 -2E4A3.189[B7H3]_H1.3_1A7[CD28]_L1_Fab_(GKPGS)2_2E4A3.189[B 7H3]_H1.3_1A7[CD28]_L1_Fab-IgG1_PVA_/S267K/S364K/E357Q
QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSQVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1006 - protein, 214 aa, synthetic construct; identical to SEQ ID NO: 879
  source 1..214: note = Description of Artificial Sequence: Synthetic polypeptide; note = XENP34336 Chain 3 -1A7[CD28]_L1

SEQ ID NO: 1007 - protein, 450 aa, synthetic construct; identical to SEQ ID NO: 1001
  source 1..450: note = Description of Artificial Sequence: Synthetic polypeptide; note = XENP34339 Chain 1 - 1A7[CD28]_H1.14_Fab_IgG1_pI(-)_Isosteric_A_PVA_/S267K/L368D /K370S

SEQ ID NO: 1008 - protein, 680 aa, synthetic construct
  source 1..680: note = Description of Artificial Sequence: Synthetic polypeptide; note = XENP34339 Chain 2 - 2E4A3.189[B7H3]_H1.22_Fab_(GKPGS)2_2E4A3.189[B7H3]_H1.22_Fa b_IgG1_PVA_/S267K/S364K/E357Q
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSQVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1009 - protein, 214 aa, synthetic construct; identical to SEQ ID NO: 879
  source 1..214: note = Description of Artificial Sequence: Synthetic polypeptide; note = XENP34339 Chain 3 - 1A7[CD28]_L1 Light Chain

SEQ ID NO: 1010 - protein, 450 aa, synthetic construct
  source 1..450: note = Description of Artificial Sequence: Synthetic polypeptide; note = XENP34398 Chain 1 -1A7[CD28]_H1.14_L1_Fab-IgG1_pI(-)_Isosteric_A_PVA_/S267K/L 368D/K370S/M428L/N434S
EVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1011 - protein, 680 aa, synthetic construct
  source 1..680: note = Description of Artificial Sequence: Synthetic polypeptide; note = XENP34398 Chain 2 -2E4A3.189[B7H3]_H1.22_1A7_L1_Fab_(GKPGS)2_2E4A3.189[B7H3]_ H1.22_1A7_L1_Fab-IgG1_PVA_/S267K/S364K/E357Q/M428L/N434S
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSQVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1012 - protein, 214 aa, synthetic construct; identical to SEQ ID NO: 879
  source 1..214: note = Description of Artificial Sequence: Synthetic polypeptide; note = XENP34398 Chain 3 -1A7[CD28]_L1

SEQ ID NO: 1013 - protein, 450 aa, synthetic construct
  source 1..450: note = Description of Artificial Sequence: Synthetic polypeptide; note = XENP35611 Chain 1 -1A7[CD28]_H1L1_Fab-IgG1_pI(-)_Isosteric_A_PVA_/S267K/L368D /K370S
EVQLLESGGGLVQPGGSLRLSCAASGFTFSSYAMSWVRQAPGKGLEWVSTISGSGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1014 - protein, 680 aa, synthetic construct; identical to SEQ ID NO: 1008
  source 1..680: note = Description of Artificial Sequence: Synthetic polypeptide; note = XENP35611 Chain 2 -2E4A3.189[B7H3]_H1.22_1A7[CD28]_L1_Fab_(GKPGS)2_2E4A3.189[ B7H3]_H1.22_1A7[CD28]_L1_Fab-IgG1_PVA_/S267K/S364K/E357Q

SEQ ID NO: 1015 - protein, 214 aa, synthetic construct; identical to SEQ ID NO: 879
  source 1..214: note = Description of Artificial Sequence: Synthetic polypeptide; note = XENP35611 Chain 3 -1A7[CD28]_L1

SEQ ID NO: 1016 - protein, 450 aa, synthetic construct
  source 1..450: note = Description of Artificial Sequence: Synthetic polypeptide; note = XENP35612 Chain 1 -1A7[CD28]_H1.1_L1_Fab-IgG1_pI(-)_Isosteric_A_PVA_/S267K/L3 68D/K370S
EVQLLESGGGLVQPGGSLRLSCAASGFTFSSYYMSWVRQAPGKGLEWVSTISGSGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1017 - protein, 680 aa, synthetic construct; identical to SEQ ID NO: 1008
  source 1..680: note = Description of Artificial Sequence: Synthetic polypeptide; note = XENP35612 Chain 2 -2E4A3.189[B7H3]_H1.22_1A7[CD28]_L1_Fab_(GKPGS)2_2E4A3.189[ B7H3]_H1.22_1A7[CD28]_L1_Fab-IgG1_PVA_/S267K/S364K/E357Q

SEQ ID NO: 1018 - protein, 214 aa, synthetic construct; identical to SEQ ID NO: 879
  source 1..214: note = Description of Artificial Sequence: Synthetic polypeptide; note = XENP35612 Chain 3 -1A7[CD28]_L1

SEQ ID NO: 1019 - protein, 450 aa, synthetic construct
  source 1..450: note = Description of Artificial Sequence: Synthetic polypeptide; note = XENP37808 Chain 1 -1A7[CD28]_H1.1_L1_Fab-IgG1_pI(-)_Isosteric_A_PVA_/S267K/L3 68D/K370S/M428L/N434S
EVQLLESGGGLVQPGGSLRLSCAASGFTFSSYYMSWVRQAPGKGLEWVSTISGSGDSTYYADSVKGRFTISRDNSKNTLYLQMNSLRAEDTAVYYCAKSGPGLRQVGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1020 - protein, 680 aa, synthetic construct; identical to SEQ ID NO: 1011
  source 1..680: note = Description of Artificial Sequence: Synthetic polypeptide; note = XENP37808 Chain 2 -2E4A3.189[B7H3]_H1.22_1A7[CD28]_L1_Fab_(GKPGS)2_2E4A3.189[ B7H3]_H1.22_1A7[CD28]_L1_Fab-IgG1_PVA_/S267K/S364K/E357Q/M4 28L/N434S

SEQ ID NO: 1021 - protein, 214 aa, synthetic construct; identical to SEQ ID NO: 879
  source 1..214: note = Description of Artificial Sequence: Synthetic polypeptide; note = XENP37808 Chain 3 -1A7[CD28]_L1

SEQ ID NO: 1022 - protein, 450 aa, synthetic construct; identical to SEQ ID NO: 1010
  source 1..450: note = Description of Artificial Sequence: Synthetic polypeptide; note = XENP37810 Chain 1 -1A7[CD28]_H1.14_L1_Fab-IgG1_pI(-)_Isosteric_A_PVA_/S267K/L 368D/K370S/M428L/N434S

SEQ ID NO: 1023 - protein, 680 aa, synthetic construct
  source 1..680: note = Description of Artificial Sequence: Synthetic polypeptide; note = XENP37810 Chain 2 -2E4A3.189[B7H3]_H1.3_1A7[CD28]_L1_Fab_(GKPGS)2_2E4A3.189[B 7H3]_H1.3_1A7[CD28]_L1_Fab-IgG1_PVA_/S267K/S364K/E357Q/M428 L/N434S
QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSQVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1024 - protein, 214 aa, synthetic construct; identical to SEQ ID NO: 879
  source 1..214: note = Description of Artificial Sequence: Synthetic polypeptide; note = XENP37810 Chain 3 -1A7[CD28]_L1

SEQ ID NO: 1025 - protein, 450 aa, synthetic construct; identical to SEQ ID NO: 983
  source 1..450: note = Description of Artificial Sequence: Synthetic polypeptide; note = XENP36781 Chain 1 - 6A1[B7H3]_H1L1_Fab-IgG1_pI(-)_Isosteric_A_/PVA_/S267K/L368D /K370S/M428L/N434S

SEQ ID NO: 1026 - protein, 712 aa, synthetic construct
  source 1..712: note = Description of Artificial Sequence: Synthetic polypeptide; note = XENP36781 Chain 2 - 6A1[B7H3]_H1L1_Fab-IgG1_PVA_/S267K/S364K/E357Q/M428L/N434S/ K447del_(G4S)3_1A7[CD28]_H1.14_L1_scFv(GKPGS)4
EVQLLESGGGLVQPGGSLRLSCAASGFTFSNYYMAWVRQAPGKGLEWVSSISTGGGSTYYRDSVKGRFTISRDNSKSTLYLQMNSLRAEDTAVYYCTTDLSAIAATPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGGGGGSGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 1027 - protein, 213 aa, synthetic construct; identical to SEQ ID NO: 955
  source 1..213: note = Description of Artificial Sequence: Synthetic polypeptide; note = XENP36781 Chain 3 - 6A1[B7H3]_L1

SEQ ID NO: 1028 - protein, 448 aa, synthetic construct
  source 1..448: note = Description of Artificial Sequence: Synthetic polypeptide; note = XENP37805 Chain 1 - 2E4A3.189[B7H3]_H1L1_Fab-IgG1_pI(-)_Isosteric_A_/PVA_/S267K /L368D/K370S/M428L/N434S
QVQLVQSGAEVKKPGASVKVSCKASGYIFTNYYMHWVRQAPGQGLEWMGIISPSAGTTSYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1029 - protein, 710 aa, synthetic construct
  source 1..710: note = Description of Artificial Sequence: Synthetic polypeptide; note = XENP37805 Chain 2 - 2E4A3.189[B7H3]_H1L1_Fab-IgG1_PVA_/S267K/S364K/E357Q/M428L/ N434S/K447del_(G4S)3_1A7[CD28]_H1.14_L1_scFv(GKPGS)4
QVQLVQSGAEVKKPGASVKVSCKASGYIFTNYYMHWVRQAPGQGLEWMGIISPSAGTTSYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGGGGGSGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 1030 - protein, 214 aa, synthetic construct; identical to SEQ ID NO: 937
  source 1..214: note = Description of Artificial Sequence: Synthetic polypeptide; note = XENP37805 Chain 3 - 2E4A3.189[B7H3]_L1

SEQ ID NO: 1031 - protein, 448 aa, synthetic construct
  source 1..448: note = Description of Artificial Sequence: Synthetic polypeptide; note = XENP37806 Chain 1 - 2E4A3.189[B7H3]_H1.3_L1_Fab-IgG1_pI(-)_Isosteric_A_/PVA_/S2 67K/L368D/K370S/M428L/N434S
QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1032 - protein, 710 aa, synthetic construct
  source 1..710: note = Description of Artificial Sequence: Synthetic polypeptide; note = XENP37806 Chain 2 - 2E4A3.189[B7H3]_H1.3_L1_Fab-IgG1_PVA_/S267K/S364K/E357Q/M42 8L/N434S/K447del_(G4S)3_1A7[CD28]_H1.14_L1_scFv(GKPGS)4
QVQLVQSGAEVKKPGASVKVSCKASGYIFTNHYMHWVRQAPGQGLEWMGIISPSAGSTDYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGGGGGSGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 1033 - protein, 214 aa, synthetic construct; identical to SEQ ID NO: 937
  source 1..214: note = Description of Artificial Sequence: Synthetic polypeptide; note = XENP37806 Chain 3 - 2E4A3.189[B7H3]_L1

SEQ ID NO: 1034 - protein, 448 aa, synthetic construct
  source 1..448: note = Description of Artificial Sequence: Synthetic polypeptide; note = XENP37807 Chain 1 - 2E4A3.189[B7H3]_H1.22_L1_Fab-IgG1_pI(-)_Isosteric_A_/PVA_/S 267K/L368D/K370S/M428L/N434S
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1035 - protein, 710 aa, synthetic construct
  source 1..710: note = Description of Artificial Sequence: Synthetic polypeptide; note = XENP37807 Chain 2 - 2E4A3.189[B7H3]_H1.22_L1_Fab-IgG1_PVA_/S267K/S364K/E357Q/M4 28L/N434S/K447del_(G4S)3_1A7[CD28]_H1.14_L1_scFv(GKPGS)4
QVQLVQSGAEVKKPGASVKVSCKASGYIFTNNYMHWVRQAPGQGLEWMGIISPSVGRTAYAQKFQGRVTMTRDTSTSTVYMELSSLRSEDTAVYYCARGGGSSPRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGGGGGSGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 1036 - protein, 214 aa, synthetic construct; identical to SEQ ID NO: 937
  source 1..214: note = Description of Artificial Sequence: Synthetic polypeptide; note = XENP37807 Chain 3 - 2E4A3.189[B7H3]_L1

SEQ ID NO: 1037 - protein, 448 aa, synthetic construct
  source 1..448: note = Description of Artificial Sequence: Synthetic polypeptide; note = XENP37982 Chain 1 - 3C4[B7H3]_H1_L1.1_Fab-IgG1_pI(-)_Isosteric_A_/PVA_/S267K/L3 68D/K370S/M428L/N434S
QVQLVQSGAEVKKPGASVKVSCKVSGFSLTSYHVSWVRQAPGQGLEWMGAISSGGSSYYNSKFQGRVTMTRDTSTSTVYMELSSLRSEDTAVYFCTGDLGAAISWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1038 - protein, 710 aa, synthetic construct
  source 1..710: note = Description of Artificial Sequence: Synthetic polypeptide; note = XENP37982 Chain 2 - 3C4[B7H3]_H1_L1.1_Fab-IgG1_PVA_/S267K/S364K/E357Q/M428L/N43 4S/K447del_(G4S)3_1A7[CD28]_H1.14_L1_scFv(GKPGS)4
QVQLVQSGAEVKKPGASVKVSCKVSGFSLTSYHVSWVRQAPGQGLEWMGAISSGGSSYYNSKFQGRVTMTRDTSTSTVYMELSSLRSEDTAVYFCTGDLGAAISWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGGGGGSGGGGSGGGGSEVQLLESGGGLVQPGGSLRLSCAASGFTFSSYYMSWVRQAPGKGLEWVSTISESGDSTYYADSVKGRFTISRDNSKNTLYLQMNSLRAEDTAVYYCAKSGPGLRQVGFDYWGQGTLVTVSSGKPGSGKPGSGKPGSGKPGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGQGTKLEIK

SEQ ID NO: 1039 - protein, 213 aa, synthetic construct
  source 1..213: note = Description of Artificial Sequence: Synthetic polypeptide; note = XENP37982 Chain 3 - 3C4[B7H3]_L1.1
DIQMTQSPSSLSASVGDRVTITCRTSQSIYKSLAWYQQKPGKAPKLLIYNAHSLQTGIPSRFSGSGSGTDFTLTISSLQPEDFATYFCQQYYSGLTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1040 - protein, 444 aa, synthetic construct
  source 1..444: note = Description of Artificial Sequence: Synthetic polypeptide; note = XENP31602 Chain 1 - PSMA-H_H1_IgG1_pI(-)_Isosteric_A_/PVA_/S267K/L368D/K370S
EVQLVQSGAEVKKPGASVKVSCKTSGYTFTEYTIHWVRQAPGQSLEWMGNINPNNGGTTYNQKFQGRVTITVDKSTSTAYMELSSLRSEDTAVYYCAAGWNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1041 - protein, 717 aa, synthetic construct
  source 1..717: note = Description of Artificial Sequence: Synthetic polypeptide; note = XENP31602 Chain 2 - PSMA-H_H1_CH1_(G4S)2_[CD3]_H1.30_L1.47_scFv(GKPGS)4_(G4S)2_ Fc(222)_IgG1_PVA_/S267K/S364K/E357Q
EVQLVQSGAEVKKPGASVKVSCKTSGYTFTEYTIHWVRQAPGQSLEWMGNINPNNGGTTYNQKFQGRVTITVDKSTSTAYMELSSLRSEDTAVYYCAAGWNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1042 - protein, 214 aa, synthetic construct
  source 1..214: note = Description of Artificial Sequence: Synthetic polypeptide; note = XENP31602 Chain 3 - PSMA-H_L1 Light Chain
DIVMTQSPDSLAVSLGERATLSCRASQDVGTAVDWYQQKPDQSPKLLIYWASTRHTGVPDRFTGSGSGTDFTLTISSLQAEDVAVYFCQQYNSYPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1043 - protein, 444 aa, synthetic construct; identical to SEQ ID NO: 1040
  source 1..444: note = Description of Artificial Sequence: Synthetic polypeptide; note = XENP32220 Chain 1 - PSMA-H_H1_IgG1_pI(-)_Isosteric_A_/PVA_/S267K/L368D/K370S

SEQ ID NO: 1044 - protein, 717 aa, synthetic construct
  source 1..717: note = Description of Artificial Sequence: Synthetic polypeptide; note = XENP32220 Chain 2 - PSMA-H_H1_(G4S)_[CD3]_L1.47_H1.32_scFv(GKPGS)4_Fc(222)_IgG1 _C220S/PVA_/S267K/S364K/E357Q
EVQLVQSGAEVKKPGASVKVSCKTSGYTFTEYTIHWVRQAPGQSLEWMGNINPNNGGTTYNQKFQGRVTITVDKSTSTAYMELSSLRSEDTAVYYCAAGWNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1045 - protein, 214 aa, synthetic construct
  source 1..214: note = Description of Artificial Sequence: Synthetic polypeptide; note = XENP32220 Chain 3 - PSMA-H_L1.24 Light Chain
DIVMTQSPDSLAVSLGERATLSCRASQDVGTAVDWYQQKPDQSPKLLIYYASTRHTGVPDRFTGSGSGTDFTLTISSLQAEDVAVYFCQQYNSYPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1046 - protein, 254 aa, synthetic construct
  source 1..254: note = Description of Artificial Sequence: Synthetic polypeptide; note = CD3 High - [anti-CD3]_H1.30_L1.47_scFv scFv
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1047 - protein, 125 aa, synthetic construct
  source 1..125: note = Description of Artificial Sequence: Synthetic polypeptide; note = CD3 High - [anti-CD3]_H1.30_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 1048 - protein, 5 aa, synthetic construct
  source 1..5: note = Description of Artificial Sequence: Synthetic peptide; note = CD3 High - [anti-CD3]_H1.30_L1.47_scFv vhCDR1
TYAMN

SEQ ID NO: 1049 - protein, 19 aa, synthetic construct
  source 1..19: note = Description of Artificial Sequence: Synthetic peptide; note = CD3 High - [anti-CD3]_H1.30_L1.47_scFv vhCDR2
RIRSKYNNYATYYADSVKG

SEQ ID NO: 1050 - protein, 14 aa, synthetic construct
  source 1..14: note = Description of Artificial Sequence: Synthetic peptide; note = CD3 High - [anti-CD3]_H1.30_L1.47_scFv vhCDR3
HGNFGDSYVSWFAY

SEQ ID NO: 1051 - protein, 109 aa, synthetic construct
  source 1..109: note = Description of Artificial Sequence: Synthetic polypeptide; note = CD3 High - [anti-CD3]_H1.30_L1.47_scFv Variable Light (vl) Domain
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1052 - protein, 14 aa, synthetic construct
  source 1..14: note = Description of Artificial Sequence: Synthetic peptide; note = CD3 High - [anti-CD3]_H1.30_L1.47_scFv vlCDR1
GSSTGAVTTSNYAN

SEQ ID NO: 1053 - protein, 7 aa, synthetic construct
  source 1..7: note = Description of Artificial Sequence: Synthetic peptide; note = CD3 High - [anti-CD3]_H1.30_L1.47_scFv vlCDR2
GTNKRAP

SEQ ID NO: 1054 - protein, 9 aa, synthetic construct
  source 1..9: note = Description of Artificial Sequence: Synthetic peptide; note = CD3 High - [anti-CD3]_H1.30_L1.47_scFv vlCDR3
ALWYSNHWV

SEQ ID NO: 1055 - protein, 20 aa, synthetic construct
  source 1..20: note = Description of Artificial Sequence: Synthetic peptide; note = CD3 High - [anti-CD3]_H1.30_L1.47_scFv Linker
GKPGSGKPGSGKPGSGKPGS

SEQ ID NO: 1056 - protein, 254 aa, synthetic construct
  source 1..254: note = Description of Artificial Sequence: Synthetic polypeptide; note = CD3 High-Int #1 - [anti-CD3]_H1.32_L1.47_scFv scFv
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1057 - protein, 125 aa, synthetic construct
  source 1..125: note = Description of Artificial Sequence: Synthetic polypeptide; note = CD3 High-Int #1 - [anti-CD3]_H1.32_L1.47_scFv Variable Heavy (vh) Domain
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 1058 - protein, 5 aa, synthetic construct
  source 1..5: note = Description of Artificial Sequence: Synthetic peptide; note = CD3 High-Int #1 - [anti-CD3]_H1.32_L1.47_scFv vhCDR1
TYAMN

SEQ ID NO: 1059 - protein, 19 aa, synthetic construct
  source 1..19: note = Description of Artificial Sequence: Synthetic peptide; note = CD3 High-Int #1 - [anti-CD3]_H1.32_L1.47_scFv vhCDR2
RIRSKANNYATYYADSVKG

SEQ ID NO: 1060 - protein, 14 aa, synthetic construct
  source 1..14: note = Description of Artificial Sequence: Synthetic peptide; note = CD3 High-Int #1 - [anti-CD3]_H1.32_L1.47_scFv vhCDR3
HGNFGDSYVSWFAY

SEQ ID NO: 1061 - protein, 109 aa, synthetic construct; identical to SEQ ID NO: 1051
  source 1..109: note = Description of Artificial Sequence: Synthetic polypeptide; note = CD3 High-Int #1 - [anti-CD3]_H1.32_L1.47_scFv Variable Light (vl) Domain

SEQ ID NO: 1062 - protein, 14 aa, synthetic construct
  source 1..14: note = Description of Artificial Sequence: Synthetic peptide; note = CD3 High-Int #1 - [anti-CD3]_H1.32_L1.47_scFv vlCDR1
GSSTGAVTTSNYAN

SEQ ID NO: 1063 - protein, 7 aa, synthetic construct
  source 1..7: note = Description of Artificial Sequence: Synthetic peptide; note = CD3 High-Int #1 - [anti-CD3]_H1.32_L1.47_scFv vlCDR2
GTNKRAP

SEQ ID NO: 1064 - protein, 9 aa, synthetic construct
  source 1..9: note = Description of Artificial Sequence: Synthetic peptide; note = CD3 High-Int #1 - [anti-CD3]_H1.32_L1.47_scFv vlCDR3
ALWYSNHWV

SEQ ID NO: 1065 - protein, 20 aa, synthetic construct
  source 1..20: note = Description of Artificial Sequence: Synthetic peptide; note = CD3 High-Int #1 - [anti-CD3]_H1.32_L1.47_scFv Linker
GKPGSGKPGSGKPGSGKPGS

SEQ ID NO: 1066 - protein, 254 aa, synthetic construct
  source 1..254: note = Description of Artificial Sequence: Synthetic polypeptide; note = CD3 High-Int #2 - [anti-CD3]_H1.89_L1.47_scFv scFv
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1067 - protein, 125 aa, synthetic construct
  source 1..125: note = Description of Artificial Sequence: Synthetic polypeptide; note = CD3 High-Int #2 - [anti-CD3]_H1.89_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 1068 - protein, 5 aa, synthetic construct
  source 1..5: note = Description of Artificial Sequence: Synthetic peptide; note = CD3 High-Int #2 - [anti-CD3]_H1.89_L1.47_scFv vhCDR1
TYAMN

SEQ ID NO: 1069 - protein, 19 aa, synthetic construct
  source 1..19: note = Description of Artificial Sequence: Synthetic peptide; note = CD3 High-Int #2 - [anti-CD3]_H1.89_L1.47_scFv vhCDR2
RIRSKYNNYATYYADSVKG

SEQ ID NO: 1070 - protein, 14 aa, synthetic construct
  source 1..14: note = Description of Artificial Sequence: Synthetic peptide; note = CD3 High-Int #2 - [anti-CD3]_H1.89_L1.47_scFv vhCDR3
HGNFGDEYVSWFAY

SEQ ID NO: 1071 - protein, 109 aa, synthetic construct; identical to SEQ ID NO: 1051
  source 1..109: note = Description of Artificial Sequence: Synthetic polypeptide; note = CD3 High-Int #2 - [anti-CD3]_H1.89_L1.47_scFv Variable Light (vl) Domain

SEQ ID NO: 1072 - protein, 14 aa, synthetic construct
  source 1..14: note = Description of Artificial Sequence: Synthetic peptide; note = CD3 High-Int #2 - [anti-CD3]_H1.89_L1.47_scFv vlCDR1
GSSTGAVTTSNYAN

SEQ ID NO: 1073 - protein, 7 aa, synthetic construct
  source 1..7: note = Description of Artificial Sequence: Synthetic peptide; note = CD3 High-Int #2 - [anti-CD3]_H1.89_L1.47_scFv vlCDR2
GTNKRAP

SEQ ID NO: 1074 - protein, 9 aa, synthetic construct
  source 1..9: note = Description of Artificial Sequence: Synthetic peptide; note = CD3 High-Int #2 - [anti-CD3]_H1.89_L1.47_scFv vlCDR3
ALWYSNHWV

SEQ ID NO: 1075 - protein, 20 aa, synthetic construct
  source 1..20: note = Description of Artificial Sequence: Synthetic peptide; note = CD3 High-Int #2 - [anti-CD3]_H1.89_L1.47_scFv Linker
GKPGSGKPGSGKPGSGKPGS

SEQ ID NO: 1076 - protein, 254 aa, synthetic construct
  source 1..254: note = Description of Artificial Sequence: Synthetic polypeptide; note = CD3 High-Int - [anti-CD3]_H1.90_L1.47_scFv scFv
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1077 - protein, 125 aa, synthetic construct
  source 1..125: note = Description of Artificial Sequence: Synthetic polypeptide; note = CD3 High-Int - [anti-CD3]_H1.90_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 1078 - protein, 5 aa, synthetic construct
  source 1..5: note = Description of Artificial Sequence: Synthetic peptide; note = CD3 High-Int - [anti-CD3]_H1.90_L1.47_scFv vhCDR1
TYAMN

SEQ ID NO: 1079 - protein, 19 aa, synthetic construct
  source 1..19: note = Description of Artificial Sequence: Synthetic peptide; note = CD3 High-Int - [anti-CD3]_H1.90_L1.47_scFv vhCDR2
RIRSKYNNYATYYADSVKG

SEQ ID NO: 1080 - protein, 14 aa, synthetic construct
  source 1..14: note = Description of Artificial Sequence: Synthetic peptide; note = CD3 High-Int - [anti-CD3]_H1.90_L1.47_scFv vhCDR3
HGNFGDPYVSWFAY

SEQ ID NO: 1081 - protein, 109 aa, synthetic construct; identical to SEQ ID NO: 1051
  source 1..109: note = Description of Artificial Sequence: Synthetic polypeptide; note = CD3 High-Int - [anti-CD3]_H1.90_L1.47_scFv Variable Light (vl) Domain

SEQ ID NO: 1082 - protein, 14 aa, synthetic construct
  source 1..14: note = Description of Artificial Sequence: Synthetic peptide; note = CD3 High-Int - [anti-CD3]_H1.90_L1.47_scFv vlCDR1
GSSTGAVTTSNYAN

SEQ ID NO: 1083 - protein, 7 aa, synthetic construct
  source 1..7: note = Description of Artificial Sequence: Synthetic peptide; note = CD3 High-Int - [anti-CD3]_H1.90_L1.47_scFv vlCDR2
GTNKRAP

SEQ ID NO: 1084 - protein, 9 aa, synthetic construct
  source 1..9: note = Description of Artificial Sequence: Synthetic peptide; note = CD3 High-Int - [anti-CD3]_H1.90_L1.47_scFv vlCDR3
ALWYSNHWV

SEQ ID NO: 1085 - protein, 20 aa, synthetic construct
  source 1..20: note = Description of Artificial Sequence: Synthetic peptide; note = CD3 High-Int - [anti-CD3]_H1.90_L1.47_scFv Linker
GKPGSGKPGSGKPGSGKPGS

SEQ ID NO: 1086 - protein, 254 aa, synthetic construct
  source 1..254: note = Description of Artificial Sequence: Synthetic polypeptide; note = Anti-CD3-Intermediate - [anti-CD3]_H1.33_L1.47_scFv scFv
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1087 - protein, 125 aa, synthetic construct
  source 1..125: note = Description of Artificial Sequence: Synthetic polypeptide; note = Anti-CD3-Intermediate - [anti-CD3]_H1.33_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 1088 - protein, 5 aa, synthetic construct
  source 1..5: note = Description of Artificial Sequence: Synthetic peptide; note = Anti-CD3-Intermediate - [anti-CD3]_H1.33_L1.47_scFv vhCDR1
TYAMN

SEQ ID NO: 1089 - protein, 19 aa, synthetic construct
  source 1..19: note = Description of Artificial Sequence: Synthetic peptide; note = Anti-CD3-Intermediate - [anti-CD3]_H1.33_L1.47_scFv vhCDR2
RIRSKYNNYATYYADSVKG

SEQ ID NO: 1090 - protein, 14 aa, synthetic construct
  source 1..14: note = Description of Artificial Sequence: Synthetic peptide; note = Anti-CD3-Intermediate - [anti-CD3]_H1.33_L1.47_scFv vhCDR3
HGNFGDSYVSWFDY

SEQ ID NO: 1091 - protein, 109 aa, synthetic construct; identical to SEQ ID NO: 1051
  source 1..109: note = Description of Artificial Sequence: Synthetic polypeptide; note = Anti-CD3-Intermediate - [anti-CD3]_H1.33_L1.47_scFv Variable Light (vl) Domain

SEQ ID NO: 1092 - protein, 14 aa, synthetic construct
  source 1..14: note = Description of Artificial Sequence: Synthetic peptide; note = Anti-CD3-Intermediate - [anti-CD3]_H1.33_L1.47_scFv vlCDR1
GSSTGAVTTSNYAN

SEQ ID NO: 1093 - protein, 7 aa, synthetic construct
  source 1..7: note = Description of Artificial Sequence: Synthetic peptide; note = Anti-CD3-Intermediate - [anti-CD3]_H1.33_L1.47_scFv vlCDR2
GTNKRAP

SEQ ID NO: 1094 - protein, 9 aa, synthetic construct
  source 1..9: note = Description of Artificial Sequence: Synthetic peptide; note = Anti-CD3-Intermediate - [anti-CD3]_H1.33_L1.47_scFv vlCDR3
ALWYSNHWV

SEQ ID NO: 1095 - protein, 20 aa, synthetic construct
  source 1..20: note = Description of Artificial Sequence: Synthetic peptide; note = Anti-CD3-Intermediate - [anti-CD3]_H1.33_L1.47_scFv Linker
GKPGSGKPGSGKPGSGKPGS

SEQ ID NO: 1096 - protein, 254 aa, synthetic construct
  source 1..254: note = Description of Artificial Sequence: Synthetic polypeptide; note = CD3 High-Int - [anti-CD3]_H1.31_L1.47_scFv scFv
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1097 - protein, 125 aa, synthetic construct
  source 1..125: note = Description of Artificial Sequence: Synthetic polypeptide; note = CD3 High-Int - [anti-CD3]_H1.31_L1.47_scFv Variable Heavy (vh) Domain
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 1098 - protein, 5 aa, synthetic construct
  source 1..5: note = Description of Artificial Sequence: Synthetic peptide; note = CD3 High-Int - [anti-CD3]_H1.31_L1.47_scFv vhCDR1
TYAMS

SEQ ID NO: 1099 - protein, 19 aa, synthetic construct
  source 1..19: note = Description of Artificial Sequence: Synthetic peptide; note = CD3 High-Int - [anti-CD3]_H1.31_L1.47_scFv vhCDR2
RIRSKYNNYATYYADSVKG

SEQ ID NO: 1100 - protein, 14 aa, synthetic construct
  source 1..14: note = Description of Artificial Sequence: Synthetic peptide; note = CD3 High-Int - [anti-CD3]_H1.31_L1.47_scFv vhCDR3
HGNFGDSYVSWFAY

SEQ ID NO: 1101 - protein, 109 aa, synthetic construct; identical to SEQ ID NO: 1051
  source 1..109: note = Description of Artificial Sequence: Synthetic polypeptide; note = CD3 High-Int - [anti-CD3]_H1.31_L1.47_scFv Variable Light (vl) Domain

SEQ ID NO: 1102 - protein, 14 aa, synthetic construct
  source 1..14: note = Description of Artificial Sequence: Synthetic peptide; note = CD3 High-Int - [anti-CD3]_H1.31_L1.47_scFv vlCDR1
GSSTGAVTTSNYAN

SEQ ID NO: 1103 - protein, 7 aa, synthetic construct
  source 1..7: note = Description of Artificial Sequence: Synthetic peptide; note = CD3 High-Int - [anti-CD3]_H1.31_L1.47_scFv vlCDR2
GTNKRAP

SEQ ID NO: 1104 - protein, 9 aa, synthetic construct
  source 1..9: note = Description of Artificial Sequence: Synthetic peptide; note = CD3 High-Int - [anti-CD3]_H1.31_L1.47_scFv vlCDR3
ALWYSNHWV

SEQ ID NO: 1105 - protein, 20 aa, synthetic construct
  source 1..20: note = Description of Artificial Sequence: Synthetic peptide; note = CD3 High-Int - [anti-CD3]_H1.31_L1.47_scFv Linker
GKPGSGKPGSGKPGSGKPGS

SEQ ID NO: 1106 - protein, 254 aa, synthetic construct
  source 1..254: note = Description of Artificial Sequence: Synthetic polypeptide; note = CD3 High[VL-VH] - [anti-CD3]_L1.47_ H1.30_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 1107 - protein, 109 aa, synthetic construct; identical to SEQ ID NO: 1051
  source 1..109: note = Description of Artificial Sequence: Synthetic polypeptide; note = CD3 High[VL-VH] - [anti-CD3]_L1.47_ H1.30_scFv Variable Light (vl) Domain

SEQ ID NO: 1108 - protein, 14 aa, synthetic construct
  source 1..14: note = Description of Artificial Sequence: Synthetic peptide; note = CD3 High[VL-VH] - [anti-CD3]_L1.47_ H1.30_scFv vlCDR1
GSSTGAVTTSNYAN

SEQ ID NO: 1109 - protein, 7 aa, synthetic construct
  source 1..7: note = Description of Artificial Sequence: Synthetic peptide; note = CD3 High[VL-VH] - [anti-CD3]_L1.47_ H1.30_scFv vlCDR2
GTNKRAP

SEQ ID NO: 1110 - protein, 9 aa, synthetic construct
  source 1..9: note = Description of Artificial Sequence: Synthetic peptide; note = CD3 High[VL-VH] - [anti-CD3]_L1.47_ H1.30_scFv vlCDR3
ALWYSNHWV

SEQ ID NO: 1111 - protein, 125 aa, synthetic construct; identical to SEQ ID NO: 1047
  source 1..125: note = Description of Artificial Sequence: Synthetic polypeptide; note = CD3 High[VL-VH] - [anti-CD3]_L1.47_ H1.30_scFv Variable Heavy (vh) Domain

SEQ ID NO: 1112 - protein, 5 aa, synthetic construct
  source 1..5: note = Description of Artificial Sequence: Synthetic peptide; note = CD3 High[VL-VH] - [anti-CD3]_L1.47_ H1.30_scFv vhCDR1
TYAMN

SEQ ID NO: 1113 - protein, 19 aa, synthetic construct
  source 1..19: note = Description of Artificial Sequence: Synthetic peptide; note = CD3 High[VL-VH] - [anti-CD3]_L1.47_ H1.30_scFv vhCDR2
RIRSKYNNYATYYADSVKG

SEQ ID NO: 1114 - protein, 14 aa, synthetic construct
  source 1..14: note = Description of Artificial Sequence: Synthetic peptide; note = CD3 High[VL-VH] - [anti-CD3]_L1.47_ H1.30_scFv vhCDR3
HGNFGDSYVSWFAY

SEQ ID NO: 1115 - protein, 20 aa, synthetic construct
  source 1..20: note = Description of Artificial Sequence: Synthetic peptide; note = CD3 High[VL-VH] - [anti-CD3]_L1.47_ H1.30_scFv Linker
GKPGSGKPGSGKPGSGKPGS

SEQ ID NO: 1116 - protein, 254 aa, synthetic construct
  source 1..254: note = Description of Artificial Sequence: Synthetic polypeptide; note = CD3 High-Int #1[VL-VH] - [anti-CD3]_L1.47_ H1.32_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 1117 - protein, 109 aa, synthetic construct; identical to SEQ ID NO: 1051
  source 1..109: note = Description of Artificial Sequence: Synthetic polypeptide; note = CD3 High-Int #1[VL-VH] - [anti-CD3]_L1.47_ H1.32_scFv Variable Light (vl) Domain

SEQ ID NO: 1118 - protein, 14 aa, synthetic construct
  source 1..14: note = Description of Artificial Sequence: Synthetic peptide; note = CD3 High-Int #1[VL-VH] - [anti-CD3]_L1.47_ H1.32_scFv vlCDR1
GSSTGAVTTSNYAN

SEQ ID NO: 1119 - protein, 7 aa, synthetic construct
  source 1..7: note = Description of Artificial Sequence: Synthetic peptide; note = CD3 High-Int #1[VL-VH] - [anti-CD3]_L1.47_ H1.32_scFv vlCDR2
GTNKRAP

SEQ ID NO: 1120 - protein, 9 aa, synthetic construct
  source 1..9: note = Description of Artificial Sequence: Synthetic peptide; note = CD3 High-Int #1[VL-VH] - [anti-CD3]_L1.47_ H1.32_scFv vlCDR3
ALWYSNHWV

SEQ ID NO: 1121 - protein, 125 aa, synthetic construct; identical to SEQ ID NO: 1057
  source 1..125: note = Description of Artificial Sequence: Synthetic polypeptide; note = CD3 High-Int #1[VL-VH] - [anti-CD3]_L1.47_ H1.32_scFv Variable Heavy (vh) Domain

SEQ ID NO: 1122 - protein, 5 aa, synthetic construct
  source 1..5: note = Description of Artificial Sequence: Synthetic peptide; note = CD3 High-Int #1[VL-VH] - [anti-CD3]_L1.47_ H1.32_scFv vhCDR1
TYAMN

SEQ ID NO: 1123 - protein, 19 aa, synthetic construct
  source 1..19: note = Description of Artificial Sequence: Synthetic peptide; note = CD3 High-Int #1[VL-VH] - [anti-CD3]_L1.47_ H1.32_scFv vhCDR2
RIRSKANNYATYYADSVKG

SEQ ID NO: 1124 - protein, 14 aa, synthetic construct
  source 1..14: note = Description of Artificial Sequence: Synthetic peptide; note = CD3 High-Int #1[VL-VH] - [anti-CD3]_L1.47_ H1.32_scFv vhCDR3
HGNFGDSYVSWFAY

SEQ ID NO: 1125 - protein, 20 aa, synthetic construct
  source 1..20: note = Description of Artificial Sequence: Synthetic peptide; note = CD3 High-Int #1[VL-VH] - [anti-CD3]_L1.47_ H1.32_scFv Linker
GKPGSGKPGSGKPGSGKPGS

SEQ ID NO: 1126 - protein, 254 aa, synthetic construct
  source 1..254: note = Description of Artificial Sequence: Synthetic polypeptide; note = CD3 High-Int #2[VL-VH] - [anti-CD3]_L1.47_ H1.89_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 1127 - protein, 109 aa, synthetic construct; identical to SEQ ID NO: 1051
  source 1..109: note = Description of Artificial Sequence: Synthetic polypeptide; note = CD3 High-Int #2[VL-VH] - [anti-CD3]_L1.47_ H1.89_scFv Variable Light (vl) Domain

SEQ ID NO: 1128 - protein, 14 aa, synthetic construct
  source 1..14: note = Description of Artificial Sequence: Synthetic peptide; note = CD3 High-Int #2[VL-VH] - [anti-CD3]_L1.47_ H1.89_scFv vlCDR1
GSSTGAVTTSNYAN

SEQ ID NO: 1129 - protein, 7 aa, synthetic construct
  source 1..7: note = Description of Artificial Sequence: Synthetic peptide; note = CD3 High-Int #2[VL-VH] - [anti-CD3]_L1.47_ H1.89_scFv vlCDR2
GTNKRAP

SEQ ID NO: 1130 - protein, 9 aa, synthetic construct
  source 1..9: note = Description of Artificial Sequence: Synthetic peptide; note = CD3 High-Int #2[VL-VH] - [anti-CD3]_L1.47_ H1.89_scFv vlCDR3
ALWYSNHWV

SEQ ID NO: 1131 - protein, 125 aa, synthetic construct; identical to SEQ ID NO: 1067
  source 1..125: note = Description of Artificial Sequence: Synthetic polypeptide; note = CD3 High-Int #2[VL-VH] - [anti-CD3]_L1.47_ H1.89_scFv Variable Heavy (vh) Domain

SEQ ID NO: 1132 - protein, 5 aa, synthetic construct
  source 1..5: note = Description of Artificial Sequence: Synthetic peptide; note = CD3 High-Int #2[VL-VH] - [anti-CD3]_L1.47_ H1.89_scFv vhCDR1
TYAMN

SEQ ID NO: 1133 - protein, 19 aa, synthetic construct
  source 1..19: note = Description of Artificial Sequence: Synthetic peptide; note = CD3 High-Int #2[VL-VH] - [anti-CD3]_L1.47_ H1.89_scFv vhCDR2
RIRSKYNNYATYYADSVKG

SEQ ID NO: 1134 - protein, 14 aa, synthetic construct
  source 1..14: note = Description of Artificial Sequence: Synthetic peptide; note = CD3 High-Int #2[VL-VH] - [anti-CD3]_L1.47_ H1.89_scFv vhCDR3
HGNFGDEYVSWFAY

SEQ ID NO: 1135 - protein, 20 aa, synthetic construct
  source 1..20: note = Description of Artificial Sequence: Synthetic peptide; note = CD3 High-Int #2[VL-VH] - [anti-CD3]_L1.47_ H1.89_scFv Linker
GKPGSGKPGSGKPGSGKPGS

SEQ ID NO: 1136 - protein, 254 aa, synthetic construct
  source 1..254: note = Description of Artificial Sequence: Synthetic polypeptide; note = CD3 High-Int[VL-VH] - [anti-CD3]_L1.47_ H1.90_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 1137 - protein, 109 aa, synthetic construct; identical to SEQ ID NO: 1051
  source 1..109: note = Description of Artificial Sequence: Synthetic polypeptide; note = CD3 High-Int[VL-VH] - [anti-CD3]_L1.47_ H1.90_scFv Variable Light (vl) Domain

SEQ ID NO: 1138 - protein, 14 aa, synthetic construct
  source 1..14: note = Description of Artificial Sequence: Synthetic peptide; note = CD3 High-Int[VL-VH] - [anti-CD3]_L1.47_ H1.90_scFv vlCDR1
GSSTGAVTTSNYAN

SEQ ID NO: 1139 - protein, 7 aa, synthetic construct
  source 1..7: note = Description of Artificial Sequence: Synthetic peptide; note = CD3 High-Int[VL-VH] - [anti-CD3]_L1.47_ H1.90_scFv vlCDR2
GTNKRAP

SEQ ID NO: 1140 - protein, 9 aa, synthetic construct
  source 1..9: note = Description of Artificial Sequence: Synthetic peptide; note = CD3 High-Int[VL-VH] - [anti-CD3]_L1.47_ H1.90_scFv vlCDR3
ALWYSNHWV

SEQ ID NO: 1141 - protein, 125 aa, synthetic construct; identical to SEQ ID NO: 1077
  source 1..125: note = Description of Artificial Sequence: Synthetic polypeptide; note = CD3 High-Int[VL-VH] - [anti-CD3]_L1.47_ H1.90_scFv Variable Heavy (vh) Domain

SEQ ID NO: 1142 - protein, 5 aa, synthetic construct
  source 1..5: note = Description of Artificial Sequence: Synthetic peptide; note = CD3 High-Int[VL-VH] - [anti-CD3]_L1.47_ H1.90_scFv vhCDR1
TYAMN

SEQ ID NO: 1143 - protein, 19 aa, synthetic construct
  source 1..19: note = Description of Artificial Sequence: Synthetic peptide; note = CD3 High-Int[VL-VH] - [anti-CD3]_L1.47_ H1.90_scFv vhCDR2
RIRSKYNNYATYYADSVKG

SEQ ID NO: 1144 - protein, 14 aa, synthetic construct
  source 1..14: note = Description of Artificial Sequence: Synthetic peptide; note = CD3 High-Int[VL-VH] - [anti-CD3]_L1.47_ H1.90_scFv vhCDR3
HGNFGDPYVSWFAY

SEQ ID NO: 1145 - protein, 20 aa, synthetic construct
  source 1..20: note = Description of Artificial Sequence: Synthetic peptide; note = CD3 High-Int[VL-VH] - [anti-CD3]_L1.47_ H1.90_scFv Linker
GKPGSGKPGSGKPGSGKPGS

SEQ ID NO: 1146 - protein, 254 aa, synthetic construct
  source 1..254: note = Description of Artificial Sequence: Synthetic polypeptide; note = Anti-CD3-Intermediate[VL-VH] - [anti-CD3]_L1.47_ H1.33_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 1147 - protein, 109 aa, synthetic construct; identical to SEQ ID NO: 1051
  source 1..109: note = Description of Artificial Sequence: Synthetic polypeptide; note = Anti-CD3-Intermediate[VL-VH] - [anti-CD3]_L1.47_ H1.33_scFv Variable Light (vl) Domain

SEQ ID NO: 1148 - protein, 14 aa, synthetic construct
  source 1..14: note = Description of Artificial Sequence: Synthetic peptide; note = Anti-CD3-Intermediate[VL-VH] - [anti-CD3]_L1.47_ H1.33_scFv vlCDR1
GSSTGAVTTSNYAN

SEQ ID NO: 1149 - protein, 7 aa, synthetic construct
  source 1..7: note = Description of Artificial Sequence: Synthetic peptide; note = Anti-CD3-Intermediate[VL-VH] - [anti-CD3]_L1.47_ H1.33_scFv vlCDR2
GTNKRAP

SEQ ID NO: 1150 - protein, 9 aa, synthetic construct
  source 1..9: note = Description of Artificial Sequence: Synthetic peptide; note = Anti-CD3-Intermediate[VL-VH] - [anti-CD3]_L1.47_ H1.33_scFvvlCDR3
ALWYSNHWV

SEQ ID NO: 1151 - protein, 125 aa, synthetic construct; identical to SEQ ID NO: 1087
  source 1..125: note = Description of Artificial Sequence: Synthetic polypeptide; note = Anti-CD3-Intermediate[VL-VH] - [anti-CD3]_L1.47_ H1.33_scFv Variable Heavy (vh) Domain

SEQ ID NO: 1152 - protein, 5 aa, synthetic construct
  source 1..5: note = Description of Artificial Sequence: Synthetic peptide; note = Anti-CD3-Intermediate[VL-VH] - [anti-CD3]_L1.47_ H1.33_scFv vhCDR1
TYAMN

SEQ ID NO: 1153 - protein, 19 aa, synthetic construct
  source 1..19: note = Description of Artificial Sequence: Synthetic peptide; note = Anti-CD3-Intermediate[VL-VH] - [anti-CD3]_L1.47_ H1.33_scFv vhCDR2
RIRSKYNNYATYYADSVKG

SEQ ID NO: 1154 - protein, 14 aa, synthetic construct
  source 1..14: note = Description of Artificial Sequence: Synthetic peptide; note = Anti-CD3-Intermediate[VL-VH] - [anti-CD3]_L1.47_ H1.33_scFv vhCDR3
HGNFGDSYVSWFDY

SEQ ID NO: 1155 - protein, 20 aa, synthetic construct
  source 1..20: note = Description of Artificial Sequence: Synthetic peptide; note = Anti-CD3-Intermediate[VL-VH] - [anti-CD3]_L1.47_ H1.33_scFv Linker
GKPGSGKPGSGKPGSGKPGS

SEQ ID NO: 1156 - protein, 254 aa, synthetic construct
  source 1..254: note = Description of Artificial Sequence: Synthetic polypeptide; note = CD3 High-Int[VL-VH] - [anti-CD3]_L1.47_ H1.31_scFv scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 1157 - protein, 109 aa, synthetic construct; identical to SEQ ID NO: 1051
  source 1..109: note = Description of Artificial Sequence: Synthetic polypeptide; note = CD3 High-Int[VL-VH] - [anti-CD3]_L1.47_ H1.31_scFv Variable Light (vl) Domain

SEQ ID NO: 1158 - protein, 14 aa, synthetic construct
  source 1..14: note = Description of Artificial Sequence: Synthetic peptide; note = CD3 High-Int[VL-VH] - [anti-CD3]_L1.47_ H1.31_scFv vlCDR1
GSSTGAVTTSNYAN

SEQ ID NO: 1159 - protein, 7 aa, synthetic construct
  source 1..7: note = Description of Artificial Sequence: Synthetic peptide; note = CD3 High-Int[VL-VH] - [anti-CD3]_L1.47_ H1.31_scFv vlCDR2
GTNKRAP

SEQ ID NO: 1160 - protein, 9 aa, synthetic construct
  source 1..9: note = Description of Artificial Sequence: Synthetic peptide; note = CD3 High-Int[VL-VH] - [anti-CD3]_L1.47_ H1.31_scFv vlCDR3
ALWYSNHWV

SEQ ID NO: 1161 - protein, 125 aa, synthetic construct; identical to SEQ ID NO: 1097
  source 1..125: note = Description of Artificial Sequence: Synthetic polypeptide; note = CD3 High-Int[VL-VH] - [anti-CD3]_L1.47_ H1.31_scFv Variable Heavy (vh) Domain

SEQ ID NO: 1162 - protein, 5 aa, synthetic construct
  source 1..5: note = Description of Artificial Sequence: Synthetic peptide; note = CD3 High-Int[VL-VH] - [anti-CD3]_L1.47_ H1.31_scFv vhCDR1
TYAMS

SEQ ID NO: 1163 - protein, 19 aa, synthetic construct
  source 1..19: note = Description of Artificial Sequence: Synthetic peptide; note = CD3 High-Int[VL-VH] - [anti-CD3]_L1.47_ H1.31_scFv vhCDR2
RIRSKYNNYATYYADSVKG

SEQ ID NO: 1164 - protein, 14 aa, synthetic construct
  source 1..14: note = Description of Artificial Sequence: Synthetic peptide; note = CD3 High-Int[VL-VH] - [anti-CD3]_L1.47_ H1.31_scFv vhCDR3
HGNFGDSYVSWFAY

SEQ ID NO: 1165 - protein, 20 aa, synthetic construct
  source 1..20: note = Description of Artificial Sequence: Synthetic peptide; note = CD3 High-Int[VL-VH] - [anti-CD3]_L1.47_ H1.31_scFv Linker
GKPGSGKPGSGKPGSGKPGS

SEQ ID NO: 1166 - protein, 447 aa, synthetic construct
  source 1..447: note = Description of Artificial Sequence: Synthetic polypeptide; note = XENP29154_TGN1412_hu5.11A1[CD28]_H1L1_IgG4_K447del Heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1167 - protein, 214 aa, synthetic construct
  source 1..214: note = Description of Artificial Sequence: Synthetic polypeptide; note = XENP29154_TGN1412_hu5.11A1[CD28]_ L1 Light Chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1168 - protein, 30 aa, synthetic construct
  source 1..30: note = Description of Artificial Sequence: Synthetic polypeptide; note = 2E4A3.189 VH HFR1
  VARIANT 27: note = MOD_RES - Y or L
  VARIANT 28: note = MOD_RES - I, T, P, A, S, G, L, or F
  VARIANT 30: note = MOD_RES - T, I, V, K, E, or S
QVQLVQSGAEVKKPGASVKVSCKASGXXFX

SEQ ID NO: 1169 - skipped

SEQ ID NO: 1170 - protein, 14 aa, synthetic construct
  source 1..14: note = Description of Artificial Sequence: Synthetic peptide; note = 2E4A3.189 VH HFR2
WVRQAPGQGLEWMG

SEQ ID NO: 1171 - protein, 17 aa, synthetic construct
  source 1..17: note = Description of Artificial Sequence: Synthetic peptide; note = 2E4A3.189 VH HCDR2
  VARIANT 2: note = MOD_RES - I or L
  VARIANT 3: note = MOD_RES - S, A, F, or G
  VARIANT 5: note = MOD_RES - S, I, V, L, Q, A, or G
  VARIANT 6: note = MOD_RES - A, S, V, G, or T
  VARIANT 8: note = MOD_RES - T, R, or S
  VARIANT 9: note = MOD_RES - T, W, or I
  VARIANT 10: note = MOD_RES - S, D, A, N, I, L, or Q
IXXPXXGXXXYAQKFQG

SEQ ID NO: 1172 - protein, 32 aa, synthetic construct
  source 1..32: note = Description of Artificial Sequence: Synthetic polypeptide; note = 2E4A3.189 VH HFR3
  VARIANT 2: note = MOD_RES - V or F
RXTMTRDTSTSTVYMELSSLRSEDTAVYYCAR

SEQ ID NO: 1173 - protein, 10 aa, synthetic construct
  source 1..10: note = Description of Artificial Sequence: Synthetic peptide; note = 2E4A3.189 VH HCDR3
  VARIANT 1: note = MOD_RES - G or A
  VARIANT 3: note = MOD_RES - G, F, W, L, or M
  VARIANT 8: note = MOD_RES - L, S, V, G, or Q
XGXSSPRXDY

SEQ ID NO: 1174 - protein, 11 aa, synthetic construct
  source 1..11: note = Description of Artificial Sequence: Synthetic peptide; note = 2E4A3.189 VH HFR4
WGQGTLVTVSS

SEQ ID NO: 1175 - protein, 23 aa, synthetic construct
  source 1..23: note = Description of Artificial Sequence: Synthetic peptide; note = 2E4A3.189 VL LFR1
DIQMTQSPSSLSASVGDRVTITC

SEQ ID NO: 1176 - protein, 11 aa, synthetic construct
  source 1..11: note = Description of Artificial Sequence: Synthetic peptide; note = 2E4A3.189 VL LCDR1
RASQSISSYLN

SEQ ID NO: 1177 - protein, 15 aa, synthetic construct
  source 1..15: note = Description of Artificial Sequence: Synthetic peptide; note = 2E4A3.189 VL LFR2
WYQQKPGKAPKLLIY

SEQ ID NO: 1178 - protein, 7 aa, synthetic construct
  source 1..7: note = Description of Artificial Sequence: Synthetic peptide; note = 2E4A3.189 VL LCDR2
AASSLQS

SEQ ID NO: 1179 - protein, 32 aa, synthetic construct
  source 1..32: note = Description of Artificial Sequence: Synthetic polypeptide; note = 2E4A3.189 VL LFR3
GVPSRFSGSGSGTDFTLTISSLQPEDFATYYC

SEQ ID NO: 1180 - protein, 9 aa, synthetic construct
  source 1..9: note = Description of Artificial Sequence: Synthetic peptide; note = 2E4A3.189 VL LCDR3
QQSYSTPYT

SEQ ID NO: 1181 - protein, 10 aa, synthetic construct
  source 1..10: note = Description of Artificial Sequence: Synthetic peptide; note = 2E4A3.189 VL LFR4
FGQGTKLEIK

SEQ ID NO: 1182 - protein, 15 aa, synthetic construct
  source 1..15: note = Description of Artificial Sequence: Synthetic peptide
EPKSCGKPGSGKPGS

SEQ ID NO: 1183 - protein, 10 aa, synthetic construct
  source 1..10: note = Description of Artificial Sequence: Synthetic peptide
EPKSCGKPGS

SEQ ID NO: 1184 - protein, 30 aa, synthetic construct
  source 1..30: note = Description of Artificial Sequence: Synthetic polypeptide; note = 1A7 VH HFR1
  VARIANT 28: note = MOD_RES - T, S, or N
  VARIANT 29: note = MOD_RES - F, or L
  VARIANT 30: note = MOD_RES - S, E, R, K, G, T, A, or N
EVQLLESGGGLVQPGGSLRLSCAASGFXXX

SEQ ID NO: 1185 - skipped

SEQ ID NO: 1186 - protein, 14 aa, synthetic construct
  source 1..14: note = Description of Artificial Sequence: Synthetic peptide; note = 1A7 VH HFR2
  VARIANT 14: note = MOD_RES - S or A
WVRQAPGKGLEWVX

SEQ ID NO: 1187 - protein, 17 aa, synthetic construct
  source 1..17: note = Description of Artificial Sequence: Synthetic peptide; note = 1A7 VH HCDR2
  VARIANT 1: note = MOD_RES - T or S
  VARIANT 3: note = MOD_RES - S, D, E, Y, or T
  VARIANT 4: note = MOD_RES - G, D, E, A, Y, S, N, or T
  VARIANT 5: note = MOD_RES - S, D, N, or G
  VARIANT 6: note = MOD_RES - D, T, Y, S, or A
  VARIANT 7: note = MOD_RES - D, T, Y, S, or A
  VARIANT 8: note = MOD_RES - S, Y, A, T, D, or N
XIXXXXXXTYYADSVKG

SEQ ID NO: 1188 - protein, 32 aa, synthetic construct
  source 1..32: note = Description of Artificial Sequence: Synthetic polypeptide; note = 1A7 VH HFR3
RFTISRDNSKNTLYLQMNSLRAEDTAVYYCAK

SEQ ID NO: 1189 - protein, 12 aa, synthetic construct
  source 1..12: note = Description of Artificial Sequence: Synthetic peptide; note = 1A7 VH HCDR3
SGPGLRQVGFDY

SEQ ID NO: 1190 - protein, 11 aa, synthetic construct
  source 1..11: note = Description of Artificial Sequence: Synthetic peptide; note = 1A7 VH HFR4
WGQGTLVTVSS

SEQ ID NO: 1191 - protein, 23 aa, synthetic construct
  source 1..23: note = Description of Artificial Sequence: Synthetic peptide; note = 1A7 VL LFR1
DIQMTQSPSSLSASVGDRVTITC

SEQ ID NO: 1192 - protein, 11 aa, synthetic construct
  source 1..11: note = Description of Artificial Sequence: Synthetic peptide; note = 1A7 VL LCDR1
  VARIANT 8: note = MOD_RES - S, A, D, G, H, K, N, Q, T, V, or Y
  VARIANT 9: note = MOD_RES - Y, A, D, F, H, K, L, N, Q, S, or W
  VARIANT 11: note = MOD_RES - N, A, D, G, H, Q, S, T, or Y
RASQSISXXLX

SEQ ID NO: 1193 - protein, 15 aa, synthetic construct
  source 1..15: note = Description of Artificial Sequence: Synthetic peptide; note = 1A7 VL LFR2
WYQQKPGKAPKLLIY

SEQ ID NO: 1194 - skipped

SEQ ID NO: 1195 - protein, 32 aa, synthetic construct; identical to SEQ ID NO: 1179
  source 1..32: note = Description of Artificial Sequence: Synthetic polypeptide; note = 1A7 VL LFR3

SEQ ID NO: 1196 - protein, 9 aa, synthetic construct
  source 1..9: note = Description of Artificial Sequence: Synthetic peptide; note = 1A7 VL LCDR3
  VARIANT 3: note = MOD_RES - S, A, D, F, H, K, L, T, V, or Y
  VARIANT 4: note = MOD_RES - Y, A, D, F, H, K, L, Q, V, or W
  VARIANT 5: note = MOD_RES - S, A, D, G, H, K, N, Q, T, V, or Y
  VARIANT 6: note = MOD_RES - T, A, D, F, I, K, L, Q, S, V, or Y
  VARIANT 8: note = MOD_RES - F, I, L, or W
QQXXXXPXT

SEQ ID NO: 1197 - protein, 10 aa, synthetic construct
  source 1..10: note = Description of Artificial Sequence: Synthetic peptide; note = 1A7 VL LFR4
FGQGTKLEIK

SEQ ID NO: 1198 - protein, 121 aa, synthetic construct
  source 1..121: note = Description of Artificial Sequence: Synthetic polypeptide; note = 1A7[CD28]_H1.41
EVQLLESGGGLVQPGGSLRLSCAASGFTFSSYYMSWVRQAPGKGLEWVSTIEGSGDYTYYADSVKGRFTISRDNSKNTLYLQMNSLRAEDTAVYYCAKSGPGLRQVGFDYWGQGTLVTVSS

SEQ ID NO: 1199 - protein, 121 aa, synthetic construct
  source 1..121: note = Description of Artificial Sequence: Synthetic polypeptide; note = 1A7[CD28]_H1.42
EVQLLESGGGLVQPGGSLRLSCAASGFTFSSYYMSWVRQAPGKGLEWVSTISESGDYTYYADSVKGRFTISRDNSKNTLYLQMNSLRAEDTAVYYCAKSGPGLRQVGFDYWGQGTLVTVSS

SEQ ID NO: 1200 - protein, 107 aa, synthetic construct
  source 1..107: note = Description of Artificial Sequence: Synthetic polypeptide; note = 1A7[CD28]_L1.105
DIQMTQSPSSLSASVGDRVTITCRASQSISSYLTWYQQKPGKAPKLLIYAASSLQSGVPSRFSGSGSGTDFTLTISSLQPEDFATYYCQQVYSTPFTFGQGTKLEIK

What is claimed:

1. A construct comprising a CD28 antigen binding domain (ABD), the CD28 binding domain comprising:

a) a variable heavy domain (VH) the amino acid sequence of SEQ ID NO:880, and b) a variable light domain (VL) having the amino acid sequence of SEQ ID NO:874.

2. A nucleic acid composition comprising:

a) a first nucleic acid encoding a variable heavy domain (VH) having the amino acid sequence of SEQ ID NO:880; and b) a second nucleic acid encoding a variable light domain (VL) having the amino acid sequence of SEQ ID NO:874.

3. An expression vector composition comprising:

a) a first expression vector comprising a first nucleic acid encoding a variable heavy domain (VH) having the amino acid sequence of SEQ ID NO:880; and b) a second expression vector comprising the second nucleic acid encoding a variable light domain (VL) having the amino acid sequence of SEQ ID NO:874.

4. A host cell comprising the nucleic acid composition of claim 2 or the expression vector composition of claim 3.

5. A method of making a construct comprising culturing the host cell of claim 3 under conditions wherein the construct is expressed and recovering the composition.

6. An antibody comprising a CD28 binding domain, wherein the CD28 binding domain comprises:

a) a variable heavy domain (VH) having the amino acid sequence of SEQ ID NO:880, and b) a variable light domain (VL) having the amino acid sequence of SEQ ID NO:874.

7. A nucleic acid composition encoding the antibody of claim 6.

8. An expression vector composition comprising the nucleic acid composition of claim 7.

9. A host cell comprising the nucleic acid composition of claim 7 or the expression vector composition of claim 8.

10. A method of making an antibody comprising culturing the host cell of claim 9 under conditions wherein the antibody is expressed and recovering the antibody.

* * * * *